US011866701B2

(12) United States Patent
Hinkle et al.

(10) Patent No.: US 11,866,701 B2
(45) Date of Patent: Jan. 9, 2024

(54) COMPLEMENT COMPONENT C3 IRNA COMPOSITIONS AND METHODS OF USE THEREOF

(71) Applicant: Alnylam Pharmaceuticals, Inc., Cambridge, MA (US)

(72) Inventors: Gregory Hinkle, Cambridge, MA (US); Anna Borodovsky, Cambridge, MA (US)

(73) Assignee: Alnylam Pharmaceuticals, Inc., Cambridge, MA (US)

( * ) Notice: Subject to any disclaimer, the term of this patent is extended or adjusted under 35 U.S.C. 154(b) by 114 days.

(21) Appl. No.: 16/760,593

(22) PCT Filed: Nov. 1, 2018

(86) PCT No.: PCT/US2018/058705
§ 371 (c)(1),
(2) Date: Apr. 30, 2020

(87) PCT Pub. No.: WO2019/089922
PCT Pub. Date: May 9, 2019

(65) Prior Publication Data
US 2021/0261959 A1 Aug. 26, 2021

Related U.S. Application Data

(60) Provisional application No. 62/580,030, filed on Nov. 1, 2017.

(51) Int. Cl.
*C12N 15/113* (2010.01)
*A61K 31/7115* (2006.01)

(52) U.S. Cl.
CPC ........ *C12N 15/113* (2013.01); *A61K 31/7115* (2013.01); *C12N 2310/14* (2013.01); *C12N 2310/315* (2013.01); *C12N 2310/321* (2013.01); *C12N 2310/322* (2013.01); *C12N 2310/351* (2013.01); *C12N 2310/3235* (2013.01); *C12N 2310/351* (2013.01)

(58) Field of Classification Search
CPC .............. C12N 15/113; C12N 2310/14; C12N 2310/315; C12N 2310/321; C12N 2310/322; C12N 2310/3235; C12N 2310/351; C12N 2310/3125; A61K 31/7115
See application file for complete search history.

(56) References Cited

U.S. PATENT DOCUMENTS

| | | | |
|---|---|---|---|
| 10,465,194 B2 | 11/2019 | Borodovsky et al. | |
| 2003/0096775 A1 | 5/2003 | Graham et al. | |
| 2007/0088154 A1 | 4/2007 | Khvorova et al. | |
| 2007/0123484 A1 | 5/2007 | Bhat | |
| 2008/0113351 A1 | 5/2008 | Naito et al. | |
| 2009/0239814 A1 | 9/2009 | Manoharan et al. | |
| 2009/0306178 A1 | 12/2009 | Bhat et al. | |
| 2013/0217756 A1 | 8/2013 | Cancilla et al. | |
| 2013/0281511 A1 | 10/2013 | Bettencourt et al. | |
| 2016/0222389 A1 | 8/2016 | Grossman | |
| 2020/0263183 A1 | 8/2020 | Borodovsky et al. | |
| 2020/0339998 A1 | 10/2020 | Borodovsky et al. | |

FOREIGN PATENT DOCUMENTS

| | | | |
|---|---|---|---|
| EP | 1752536 A1 | 2/2007 | |
| WO | WO-2006/047673 A2 | 5/2006 | |
| WO | WO-2007/064846 A2 | 6/2007 | |
| WO | WO-2007/089375 A2 | 8/2007 | |
| WO | WO-2008/036841 A2 | 3/2008 | |
| WO | WO-2010/048352 A2 | 4/2010 | |
| WO | WO-2012/037254 A1 | 3/2012 | |
| WO | WO-2013/067076 A2 | 5/2013 | |
| WO | WO-2013/074974 A2 | 5/2013 | |
| WO | WO-2014/107763 A1 | 7/2014 | |
| WO | WO-2015/038939 A2 | 3/2015 | |
| WO | WO-2015/089368 A2 | 6/2015 | |
| WO | WO-2017/040078 A1 | 3/2017 | |
| WO | WO-2018075373 A1 * | 4/2018 | ........... A61K 31/713 |
| WO | WO-2019/089922 A1 | 5/2019 | |
| WO | WO-2021/081026 A1 | 4/2021 | |
| WO | WO-2021/178607 A1 | 9/2021 | |

OTHER PUBLICATIONS

Lawson, V. and Arnold, W.D., Multifocal motor neuropathy: a review of pathogenesis, diagnosis, and treatment, 2014, Neuropsychiatric Disease and Treatment, 10, 567-576. (Year: 2014).*
Cleveland Clinic Foundation, "Lupus (Systemic Lupus Erythematosus)", https://my.clevelandclinic.org/health/diseases/4875-lupus, Accessed Nov. 8, 2022, publication reviewed Apr. 19, 2021 (Year: 2021).*
PCT/US2018/058705, Nov. 1, 2018, WO 2019/089922, Published.
U.S. Appl. No. 15/176,231 U.S. Pat. No. 10,465,194, filed Jun. 8, 2016 Nov. 5, 2019, US 20160298124, Granted.
U.S. Appl. No. 16/574,158 U.S. Pat. No. 11,186,842, filed Sep. 18, 2019 Nov. 30, 2021, US 20200263183, Granted.
U.S. Appl. No. 16/925,463, filed Jul. 10, 2020, US 20200339998, Abandoned.
U.S. Appl. No. 17/405,199, filed Aug. 18, 2021, Pending.

(Continued)

*Primary Examiner* — Ram R Shukla
*Assistant Examiner* — Keyur A Vyas
(74) *Attorney, Agent, or Firm* — McCarter & English, LLP; Maria Laccotripe Zacharakis; Deborah L. Nagle

(57) ABSTRACT

The invention relates to iRNA, e.g., double stranded ribonucleic acid (dsRNA), compositions targeting the complement factor C3 gene, and methods of using such iRNA, e.g., dsRNA, compositions to inhibit expression of a C3 gene and to treat subjects having a complement component C3-associated disease, e.g., paroxysmal nocturnal hemoglobinuria (PNH), atypical hemolytic uremic syndrome (aHUS), atypical hemolytic uremic syndrome (aHUS), neuromyelitis optica (NMO), multifocal motor neuropathy (MMN), myasthenia gravis (MG), and C3 glomerulonephritis.

24 Claims, 1 Drawing Sheet
Specification includes a Sequence Listing.

(56) References Cited

OTHER PUBLICATIONS

PCT/US2020/056563, Oct. 21, 2020, WO 2021/081026, Published.
PCT/US2021/020777, Mar. 4, 2021, WO 2021/178607, Published.
Bora et al., Complement activation via alternative pathway is critical in the development of laser-induced choroidal neovascularization: role of factor B and factor H. J Immunol. Aug. 1, 2006;177(3):1872-8.
Borodovsky et al., Development of RNAi Therapeutics Targeting the Complement Pathway. Blood. 2013;122(21)2471.
Cheng et al., [Effect of C5-siRNA silencing receptor C5 on myocardial ischemia injury in rats]. Nan Fang Yi Ke Da Xue Xue Bao. Jun. 2010;30(6):1486-8.
International Search Report and Written Opinion for Application No. PCT/US2014/069951, dated Jul. 6, 2015.
Zheng et al., "Preventing Renal Ischemia-Reperfusion Injury Using Small Interfering RNA by Targeting Complement 3 Gene," American Journal of Transplantation 2006; 6: 2099-2108.
Zheng et al., "Protection of Renal Ischemia Injury using Combination Gene Silencing of Complement 3 and Caspase 3 Genes," *Transplantation* 2006;82: 1781-1786.
Reynolds et al., "Rational siRNA design for RNA interference," Nature Biotechnology, vol. 22, pp. 326-330, 2004.
International Search Report and Written Opinion from PCT/US2018/058705, dated Mar. 1, 2019.
International Search Report and Written Opinion from PCT/US2020/056563, dated Mar. 22, 2021.
International Search Report and Written Opinion from PCT/US2021/020777, dated Aug. 16, 2021.
Vickers et al., "Efficient Reduction of Target RNAs by Small Interfering RNA and RNase H-dependent Antisense Agents", The Journal of Biological Chemistry, 2003, 278:7108-7118).
Watts et al., "Gene silencing by siRNAs and antisense oligonucleotides in the laboratory and the clinic", J Pathol 2012; 226: 365-379.

* cited by examiner

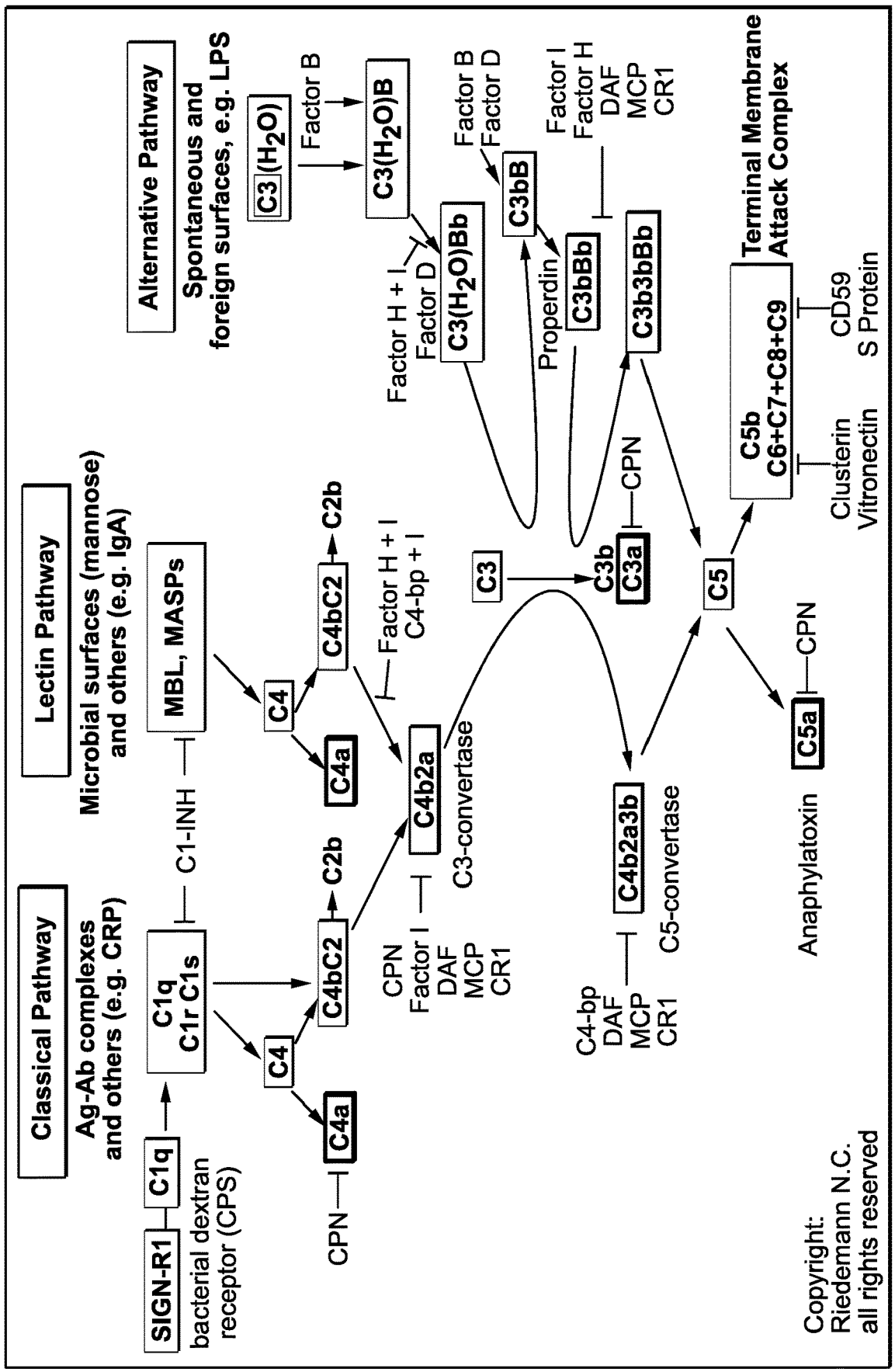

COMPLEMENT COMPONENT C3 IRNA COMPOSITIONS AND METHODS OF USE THEREOF

RELATED APPLICATIONS

This application is a 35 U.S.C. § 371 national stage filing of International Application No. PCT/US2018/058705, filed on Nov. 1, 2018, which in turn claims the benefit of priority to U.S. Provisional Patent Application No. 62/580,030, filed on Nov. 1, 2017. The entire contents of each of the foregoing applications are incorporated herein by reference.

This application is related to U.S. Provisional Patent Application No. 61/915,210, filed on Dec. 12, 2013, to International Application No. PCT/US2014/069951, filed on Dec. 12, 2014, and to U.S. patent application Ser. No. 15/176,231, filed on Jun. 8, 2016. The entire contents of each of the foregoing applications are hereby incorporated herein by reference.

SEQUENCE LISTING

The instant application contains a Sequence Listing which has been submitted electronically in ASCII format via EFS-Web and is hereby incorporated by reference in its entirety. Said ASCII copy, created on Mar. 25, 2022, is named 121301_06603_SeqList.txt and is 538,920 bytes in size.

BACKGROUND OF THE INVENTION

Complement was first discovered in the 1890s when it was found to aid or "complement" the killing of bacteria by heat-stable antibodies present in normal serum (Walport, M. J. (2001) *N Engl J Med.* 344:1058). The complement system consists of more than 30 proteins that are either present as soluble proteins in the blood or are present as membrane-associated proteins. Activation of complement leads to a sequential cascade of enzymatic reactions, known as complement activation pathways resulting in the formation of the potent anaphylatoxins C3a and C5a that elicit a plethora of physiological responses that range from chemoattraction to apoptosis. Initially, complement was thought to play a major role in innate immunity where a robust and rapid response is mounted against invading pathogens. However, recently it is becoming increasingly evident that complement also plays an important role in adaptive immunity involving T and B cells that help in elimination of pathogens (Dunkelberger J R and Song W C. (2010) *Cell Res.* 20:34; Molina H, et al. (1996) *Proc Natl Acad Sci USA.* 93:3357), in maintaining immunologic memory preventing pathogenic re-invasion, and is involved in numerous human pathological states (Qu, H, et al. (2009) *Mol Immunol.* 47:185; Wagner, E. and Frank M M. (2010) *Nat Rev Drug Discov.* 9:43).

Complement activation is known to occur through three different pathways: alternate, classical and lectin (FIG. 1) involving proteins that mostly exist as inactive zymogens that are then sequentially cleaved and activated.

The classical pathway is often activated by antibody-antigen complexes or by the C-reactive protein (CRP), both of which interact with complement component C1q. In addition, the classical pathway can be activated by phosphatidyl serine present in apoptotic bodies in the absence of immune complexes.

The lectin pathway is initiated by the mannose-binding lectins (MBL) that bind to complex carbohydrate residues on the surface of pathogens. The activation of the classical pathway or the lectin pathway leads to activation of the (C4b2b) C3 convertase.

The alternate pathway is activated by the binding of C3b, which is spontaneously generated by the hydrolysis of C3, on targeted surfaces. This surface-bound C3b is then recognized by factor B, forming the complex C3bB. The C3bB complex, in turn, is cleaved by factor D to yield the active form of the C3 convertase of the AP (C3bBb). Both types of C3 convertases will cleave C3, forming C3b. C3b then either binds to more factor B, enhancing the complement activation through the AP (the so-called alternative or amplification loop), or leads to the formation of the active C5 convertase (C3bBbC3b or C4bC2bC3b), which cleaves C5 and triggers the late events that result in the formation of the membrane attack complex (MAC) (C5b-9).

Inappropriate activation of the complement system is responsible for propagating and/or initiating pathology in many different diseases, including, for example, paroxysmal nocturnal hemoglobinuria (PNH), atypical hemolytic uremic syndrome (aHUS), neuromyelitis optica (NMO), multifocal motor neuropathy (MMN), myasthenia gravis (MG), C3 glomerulonephritis, systemic lupus erythmatosis, rheumatoid arthritis, ischemia-reperfusion injuries and neurodegenerative diseases.

To date, only one therapeutic that targets the C5-05a axis is available for the treatment of complement component C3-associated diseases, the anti-C5 antibody, eculizumab (Soliris®). Although eculizumab has been shown to be effective for the treatment of paroxysmal nocturnal hemoglobinuria (PNH) and atypical hemolytic uremic syndrome (aHUS) and is currently being evaluated in clinical trials for additional complement component C3-associated diseases, eculizumab therapy requires weekly high dose infusions followed by biweekly maintenance infusions at a high cost. Furthermore, approximately 50% of eculizumab-treated PNH subjects have low level of hemolysis and require residual transfusions (Hill A, et al. (2010) *Haematologica* 95(4):567-73). Accordingly, there is a need in the art for alternative therapies and combination therapies for subjects having a complement component C3-associated disease.

SUMMARY OF THE INVENTION

The present invention provides iRNA compositions which effect the RNA-induced silencing complex (RISC)-mediated cleavage of RNA transcripts of a C3 gene. The C3 gene may be within a cell, e.g., a cell within a subject, such as a human. The use of these iRNA agents enables the selective targeted degradation of mRNAs of the corresponding gene (the C3 gene) in mammals.

The present invention also provides methods and combination therapies for treating a subject having a disorder that would benefit from inhibiting or reducing the expression of a C3 gene, e.g., a complement component C3-associated disease, such as paroxysmal nocturnal hemoglobinuria (PNH), atypical hemolytic uremic syndrome (aHUS), atypical hemolytic uremic syndrome (aHUS), neuromyelitis optica (NMO), multifocal motor neuropathy (MMN), myasthenia gravis (MG), C3 glomerulonephritis, or systemic lupus erythmatosis using iRNA compositions which effect the RNA-induced silencing complex (RISC)-mediated cleavage of RNA transcripts of a C3 gene for inhibiting the expression of a C3 gene.

Accordingly, in one aspect the present invention provides double stranded ribonucleic acids (dsRNA) for inhibiting expression of complement component C3 in a cell, wherein the dsRNA comprises a sense strand and an antisense strand, wherein the sense strand comprises at least 15 contiguous nucleotides differing by no more than 3 nucleotides from SEQ ID NO:1, and the antisense strand comprises at least 15 contiguous nucleotides differing by no more than 3 nucleotides from the nucleotide sequence of SEQ ID NO:2.

In another aspect the present invention provides double stranded ribonucleic acids (dsRNA) for inhibiting expression of complement component C3 in a cell, wherein the dsRNA comprises a sense strand and an antisense strand, the antisense strand comprising a region of complementarity which comprises at least 15 contiguous nucleotides differing by no more than 3 nucleotides from any one of the antisense sequences listed in any one of Tables 3, 4, 6, 7, and 9.

In one embodiment the region of complementarity consists of the nucleotide sequence of one of the antisense sequences of any one of Tables 3, 4, 6, 7, and 9.

In one embodiment, the dsRNA comprises a sense strand comprising, or consisting of, the nucleotide sequence of a sense strand sequence selected from the sequence of any one of Tables 3, 4, 6, 7, and 9, and an antisense strand comprising, or consisting of, the nucleotide sequence of an antisense sequence selected from the sequences of any one of Tables 3, 4, 6, 7, and 9.

The dsRNA may include at least one modified nucleotide, e.g., a 2'-O-methyl modified nucleotide, a nucleotide comprising a 5'-phosphorothioate group, a deoxy-nucleotide, a 3'-terminal deoxy-thymine (dT) nucleotide, a 2'-O-methyl modified nucleotide, a 2'-fluoro modified nucleotide, a 2'-deoxy-modified nucleotide, a terminal nucleotide linked to a cholesteryl derivative or a dodecanoic acid bisdecylamide group, a 2'-deoxy-2'-fluoro modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxyl-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, and a nucleotide comprising a 5'-phosphate mimic.

In one embodiment, substantially all the nucleotides of the sense strand and the antisense strand are modified nucleotides. In another embodiment, all the nucleotides of the sense strand and the antisense strand are modified nucleotides.

The region of complementarity may be at least 17 nucleotides in length, such as 19 nucleotides in length, or no more than 30 nucleotides in length.

The region of complementarity may be between 19 and 21 nucleotides in length.

At least one strand of the dsRNA may include a 3' overhang of at least 1 nucleotide, or at least 2 nucleotides.

The dsRNA may further include a ligand. In one embodiment, the ligand is conjugated to the 3' end of the sense strand of the dsRNA. In one embodiment, the ligand is an N-acetylgalactosamine (GalNAc) derivative. In one embodiment, the ligand is

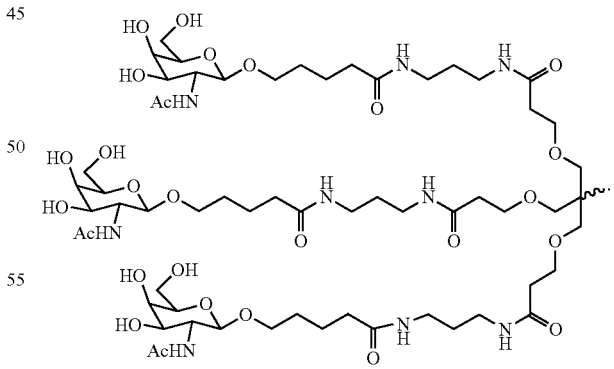

In one embodiment, the dsRNA is conjugated to the ligand as shown in the following schematic

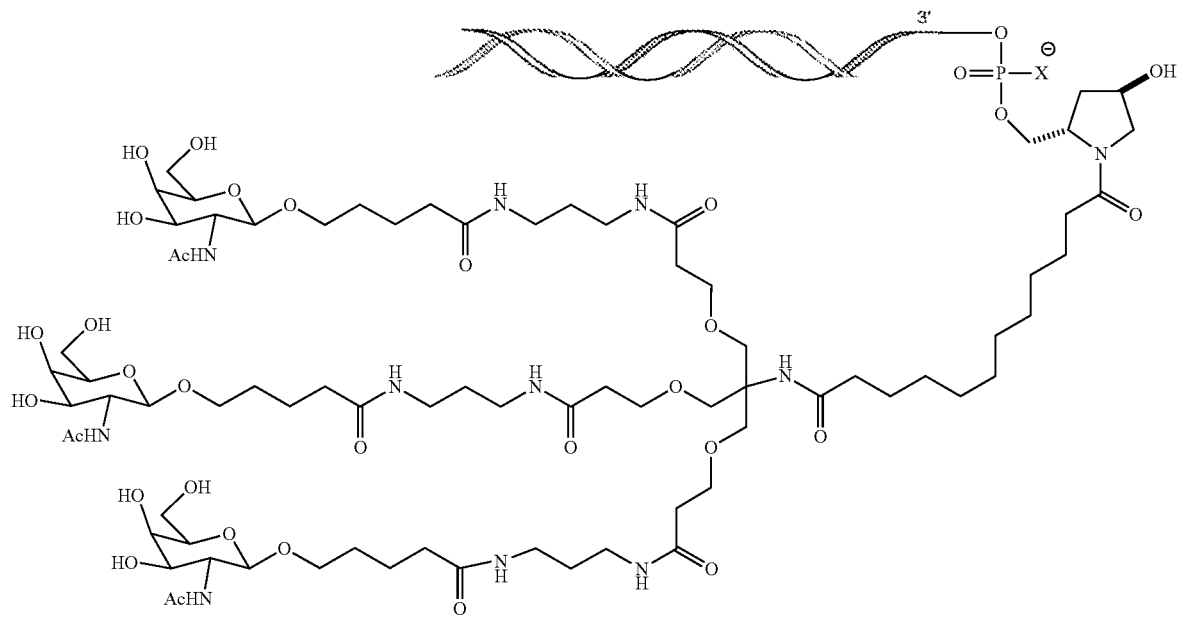

and, wherein X is O or S.

In one embodiment, the X is O.

In one embodiment, the agent further comprises at least one phosphorothioate or methylphosphonate internucleotide linkage.

In one embodiment, the phosphorothioate or methylphosphonate internucleotide linkage is at the 3'-terminus of one strand. In one embodiment, the strand is the antisense strand. In another embodiment, the strand is the sense strand.

In another embodiment, the phosphorothioate or methylphosphonate internucleotide linkage is at the 5'-terminus of one strand. In one embodiment, the strand is the antisense strand. In another embodiment, the strand is the sense strand.

In one embodiment, the phosphorothioate or methylphosphonate internucleotide linkage is at the both the 5'- and 3'-terminus of one strand. In one embodiment, the strand is the antisense strand.

In another embodiment, the RNAi agent is selected from the group of RNAi agents listed in any one of Tables 3, 4, 6, 7, and 9. In one embodiment, the RNAi agent is AD-80806. In another embodiment, the RNAi agent is AD-80807.

In another aspect, the present invention provides cells containing the agents of the invention.

In one aspect, the invention provides vectors encoding at least one strand of the agents of the invention.

In another aspect, the invention provides cells comprising the vectors of the invention.

In another aspect, the present invention provides pharmaceutical compositions for inhibiting expression of a complement component C3 gene comprising the agents of the invention.

In one embodiment, the RNAi agent is administered in an unbuffered solution.

In one embodiment, the unbuffered solution is saline or water.

In one embodiment, the RNAi agent is administered with a buffer solution.

In one embodiment, the buffer solution comprises acetate, citrate, prolamine, carbonate, or phosphate or any combination thereof.

In one embodiment, the buffer solution is phosphate buffered saline (PBS).

In one aspect, the present invention provides methods of inhibiting complement component 3 (C3) expression in a cell. The methods include contacting the cell with the agent of the invention or a pharmaceutical composition of the invention, and maintaining the cell produced for a time sufficient to obtain degradation of the mRNA transcript of a C3 gene, thereby inhibiting expression of the C3 gene in the cell.

In one embodiment, the cell is within a subject.

In one embodiment, the subject is a human.

In one embodiment, the human subject suffers from a complement component C3-associated disease.

In one embodiment, the complement component C3-associated disease is selected from the group consisting of paroxysmal nocturnal hemoglobinuria (PNH), atypical hemolytic uremic syndrome (aHUS), atypical hemolytic uremic syndrome (aHUS), neuromyelitis optica (NMO), multifocal motor neuropathy (MMN), myasthenia gravis (MG), C3 glomerulonephritis, and systemic lupus erythematosis.

In one embodiment, the C3 expression is inhibited by at least about 30%.

In one embodiment, the agent is administered at a dose of about 0.01 mg/kg to about 10 mg/kg or about 0.5 mg/kg to about 50 mg/kg.

In one embodiment, the agent is administered subcutaneously.

In another embodiment, the agent is administered intravenously.

In one aspect, the present invention provides methods of treating a subject having a disorder that would benefit from reduction in complement component C3 (C3) expression. The methods include administering to the subject a therapeutically effective amount of the agent of the invention, thereby treating the subject.

In one aspect, the present invention provides methods of preventing at least one symptom in a subject having a disease or disorder that would benefit from reduction in complement component C3 (C3) expression. The methods include administering to the subject a therapeutically effective amount of the agent of the invention, thereby preventing at least one symptom in the subject having a disorder that would benefit from reduction in C3 expression.

In one embodiment, the disorder is a complement component C3-associated disease.

In one embodiment, the complement component C3-associated disease is selected from the group consisting of paroxysmal nocturnal hemoglobinuria (PNH), atypical hemolytic uremic syndrome (aHUS), atypical hemolytic uremic syndrome (aHUS), neuromyelitis optica (NMO), multifocal motor neuropathy (MMN), myasthenia gravis (MG), C3 glomerulonephritis, and systemic lupus erythematosis. In one embodiment, the complement component C3-associated disease is systemic lupus erythematosis.

In one embodiment, the administration of the agent to the subject causes a decrease in hemolysis and/or a decrease in C3 protein accumulation.

In one embodiment, the methods further include administration of eculizumab to the subject.

In another embodiment, the methods further include administration of compstatin to the subject.

In one embodiment, the agent is administered at a dose of about 0.01 mg/kg to about 10 mg/kg or about 0.5 mg/kg to about 50 mg/kg.

In one embodiment, the methods further include measuring LDH levels in the subject.

In one aspect, the present invention provides methods of inhibiting the expression of complement component C3 (C3) in a subject. The methods include administering to the subject a therapeutically effective amount of the agent of the invention, thereby inhibiting the expression of C3 in the subject.

In one embodiment, the methods further include administering eculizumab to the subject.

In another embodiment, the methods further include administering compstatin to the subject.

In one embodiment, the agent is administered at a dose of about 0.01 mg/kg to about 10 mg/kg or about 0.5 mg/kg to about 50 mg/kg.

BRIEF DESCRIPTION OF THE DRAWINGS

FIG. 1 is a schematic of the three complement pathways: alternative, classical and lectin.

DETAILED DESCRIPTION OF THE INVENTION

The present invention provides iRNA compositions, which selectively effect the RNA-induced silencing complex (RISC)-mediated cleavage of RNA transcripts of a complement component gene, i.e., a C3 gene. The gene may be within a cell, e.g., a cell within a subject, such as a human. The use of these iRNAs enables the selective targeted degradation of mRNAs of the corresponding gene (the C3 gene) in mammals.

The RNAi agents of the invention have been designed to potently and selectively target the corresponding human C3 gene. Without intending to be limited by theory, it is believed that a combination or sub-combination of the foregoing properties and the specific target sites and/or the specific modifications in these RNAi agents confer to the RNAi agents of the invention improved efficacy, stability, potency, durability, and safety.

The iRNAs of the invention may include an RNA strand (the antisense strand) having a region which is about 30 nucleotides or less in length, e.g., 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length, which region is substantially complementary to at least part of an mRNA transcript of a human C3 gene.

In certain embodiments, the iRNAs of the invention include an RNA strand (the antisense strand) which can include longer lengths, for example up to 66 nucleotides, e.g., 36-66, 26-36, 25-36, 31-60, 22-43, 27-53 nucleotides in length with a region of at least 19 contiguous nucleotides that is substantially complementary to at least a part of an mRNA transcript of a C3 gene. These iRNAs with the longer length antisense strands preferably include a second RNA strand (the sense strand) of 20-60 nucleotides in length wherein the sense and antisense strands form a duplex of 18-30 contiguous nucleotides.

Using in vitro assays, the present inventors have demonstrated that iRNAs targeting a C3 gene can potently mediate RNAi, resulting in significant inhibition of expression of a C3 gene. Thus, methods and compositions including these iRNAs are useful for treating a subject having a complement component C3-associated disease or disorder, e.g., paroxysmal nocturnal hemoglobinuria (PNH) and atypical hemolytic uremic syndrome (aHUS), neuromyelitis optica (NMO), multifocal motor neuropathy (MMN), myasthenia gravis (MG), C3 glomerulonephritis, C3-associated disease, or systemic lupus erythematosis.

Accordingly, the present invention provides methods and combination therapies for treating a subject having a disorder that would benefit from inhibiting or reducing the expression of a C3 gene, e.g., a complement component C3-associated disease, such as paroxysmal nocturnal hemoglobinuria (PNH) and atypical hemolytic uremic syndrome (aHUS), neuromyelitis optica (NMO), multifocal motor neuropathy (MMN), myasthenia gravis (MG), C3 glomerulonephritis, or systemic lupus erythematosis, using iRNA compositions which effect the RNA-induced silencing complex (RISC)-mediated cleavage of RNA transcripts of a C3 gene.

The present invention also provides methods for preventing at least one symptom in a subject having a disorder that would benefit from inhibiting or reducing the expression of a C3 gene, e.g., a complement component C3-associated disease, such as paroxysmal nocturnal hemoglobinuria (PNH), atypical hemolytic uremic syndrome (aHUS), neuromyelitis optica (NMO), multifocal motor neuropathy (MMN), myasthenia gravis (MG), C3 glomerulonephritis, or systemic lupus erythematosis. For example, in a subject having MG the methods of the present invention may prevent at least one symptom in the subject including, e.g., hemolysis, MAC deposition, inflammation (e.g., chronic inflammation), complement activation and destruction of muscle membrane morphology; in a subject having NMO the methods of the present invention may prevent at least one symptom in the subject including, e.g., hemolysis, inflammation (e.g., chronic inflammation), and MAC tissue damage; in a subject having GN the methods of the present invention may prevent at least one symptom in the subject including, e.g., hemolysis, inflammation (e.g., chronic inflammation), and proteinuria; in a subject having aHUS the methods of the present invention may prevent at least one symptom in the subject including, e.g., hemolysis, inflammation (e.g., chronic inflammation), hypertension, proteinuria, uremia, lethargy/fatigue, irritability, thrombocytopenia, microangiopathic hemolytic anemia, and renal function impairment (e.g., acute renal failure).

The following detailed description discloses how to make and use compositions containing iRNAs to inhibit the expression of a complement C3 gene, as well as compositions, uses, and methods for treating subjects having diseases and disorders that would benefit from inhibition and/or reduction of the expression of a C3 gene.

I. Definitions

In order that the present invention may be more readily understood, certain terms are first defined. In addition, it should be noted that whenever a value or range of values of a parameter are recited, it is intended that values and ranges intermediate to the recited values are also intended to be part of this invention.

The articles "a" and "an" are used herein to refer to one or to more than one (i.e., to at least one) of the grammatical object of the article. By way of example, "an element" means one element or more than one element, e.g., a plurality of elements.

The term "including" is used herein to mean, and is used interchangeably with, the phrase "including but not limited to".

The term "or" is used herein to mean, and is used interchangeably with, the term "and/or," unless context clearly indicates otherwise.

The term "about" is used herein to mean within the typical ranges of tolerances in the art. For example, "about" can be understood as within about 2 standard deviations from the mean. In certain embodiments, about means +10%. In certain embodiments, about means +5%. When about is present before a series of numbers or a range, it is understood that "about" can modify each of the numbers in the series or range.

The term "at least" prior to a number or series of numbers is understood to include the number adjacent to the term "at least", and all subsequent numbers or integers that could logically be included, as clear from context. For example, the number of nucleotides in a nucleic acid molecule must be an integer. For example, "at least 18 nucleotides of a 21 nucleotide nucleic acid molecule" means that 18, 19, 20, or 21 nucleotides have the indicated property. When at least is present before a series of numbers or a range, it is understood that "at least" can modify each of the numbers in the series or range.

As used herein, "no more than" or "less than" is understood as the value adjacent to the phrase and logical lower values or integers, as logical from context, to zero. For example, a duplex with an overhang of "no more than 2 nucleotides" has a 2, 1, or 0 nucleotide overhang. When "no more than" is present before a series of numbers or a range, it is understood that "no more than" can modify each of the numbers in the series or range. As used herein, ranges include both the upper and lower limit.

In the event of a conflict between a sequence and its indicated site on a transcript or other sequence, the nucleotide sequence recited in the specification takes precedence.

Various embodiments of the invention can be combined as determined appropriate by one of skill in the art.

As used herein, the term "Complement Component 3," used interchangeably with the term "C3," refers to the well-known gene and polypeptide, also known in the art as ARMD9, C3a Anaphylatoxin, ASP, Complement Component C3a, C3a, Complement Component C3b, C3b, prepro-C3, Acylation-Stimulating Protein Cleavage Product, CPAMD1, Complement C3, C3 And PZP-Like Alpha-2-Macroglobulin Domain-Containing Protein 1, Complement Component C3, and AHUS5. The term "C3" includes human C3, the amino acid and nucleotide sequence of which may be found in, for example, GenBank Accession No. NM_000064.3 (GI:726965399); mouse C3, the amino acid and nucleotide sequence of which may be found in, for example, GenBank Accession No. NM_009778.3 (GI:773669943); and rat C3, the amino acid and nucleotide sequence of which may be found in, for example, GenBank Accession No. NM_016994.2 (GI:158138560).

The term "C3" also includes *Macaca fascicularis* C3, the amino acid and nucleotide sequence of which may be found in, for example, GenBank Accession No. m, butM_____005587719.2 (GI:982312947) and in the entry for the gene, ENSP00000245907 (locus=chr19:6921416:6963034), in the *Macaca* genome project web site (macaque.genomics.org.cn/page/species/index.jsp).

Additional examples of C3 mRNA sequences are readily available using, e.g., GenBank, UniProt, OMIM, and the *Macaca* genome project web site.

Exemplary C3 nucleotide sequences may also be found in SEQ ID NOs:1-8. SEQ ID NOs:5-8 are the antisense sequences of SEQ ID NOs:1-4, respectively.

Further information on C3 is provided, for example in the NCBI Gene database at www.ncbi.nlm.nih.gov/gene/718.

The entire contents of each of the foregoing GenBank Accession numbers and the Gene database numbers are incorporated herein by reference as of the date of filing this application.

The term "C3," as used herein, also refers to naturally occurring DNA sequence variations of the C3 gene. Numerous sequence variations within the C3 gene have been identified and may be found at, for example, NCBI dbSNP and UniProt (see, e.g., www.ncbi.nlm.nih.gov/snp?LinkName=gene_snp&from_uid=718, the entire contents of which is incorporated herein by reference as of the date of filing this application.

As used herein, "target sequence" refers to a contiguous portion of the nucleotide sequence of an mRNA molecule formed during the transcription of a C3 gene, including mRNA that is a product of RNA processing of a primary transcription product. In one embodiment, the target portion of the sequence will be at least long enough to serve as a substrate for iRNA-directed cleavage at or near that portion of the nucleotide sequence of an mRNA molecule formed during the transcription of a C3 gene. In one embodiment, the target sequence is within the protein coding region of a C3 gene. In another embodiment, the target sequence is within the 3' UTR of a C3 gene.

The target sequence may be from about 9-36 nucleotides in length, e.g., about 15-30 nucleotides in length. For example, the target sequence can be from about 15-30 nucleotides, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. In some embodiments, the target sequence is about 19 to about 30 nucleotides in length. In other embodiments, the target sequence is about 19 to about 25 nucleotides in length. In still other embodiments, the target sequence is about 19 to about 23 nucleotides in length. In some embodiments, the target sequence is about 21 to about 23 nucleotides in length. Ranges and lengths intermediate to the above recited ranges and lengths are also contemplated to be part of the invention.

As used herein, the term "strand comprising a sequence" refers to an oligonucleotide comprising a chain of nucleotides that is described by the sequence referred to using the standard nucleotide nomenclature.

"G," "C," "A," "T" and "U" each generally stand for a nucleotide that contains guanine, cytosine, adenine, thymidine and uracil as a base, respectively. However, it will be understood that the term "ribonucleotide" or "nucleotide" can also refer to a modified nucleotide, as further detailed below, or a surrogate replacement moiety (see, e.g., Table 2). The skilled person is well aware that guanine, cytosine, adenine, and uracil can be replaced by other moieties without substantially altering the base pairing properties of an oligonucleotide comprising a nucleotide bearing such replacement moiety. For example, without limitation, a nucleotide comprising inosine as its base can base pair with nucleotides containing adenine, cytosine, or uracil. Hence, nucleotides containing uracil, guanine, or adenine can be replaced in the nucleotide sequences of dsRNA featured in the invention by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods featured in the invention.

The terms "iRNA," "RNAi agent," "iRNA agent," "RNA interference agent" as used interchangeably herein, refer to an agent that contains RNA as that term is defined herein, and which mediates the targeted cleavage of an RNA transcript via an RNA-induced silencing complex (RISC) pathway. iRNA directs the sequence-specific degradation of mRNA through a process known as RNA interference (RNAi). The iRNA modulates, e.g., inhibits, the expression of a C3 gene in a cell, e.g., a cell within a subject, such as a mammalian subject.

In one embodiment, an RNAi agent of the invention includes a single stranded RNAi that interacts with a target RNA sequence, e.g., a C3 target mRNA sequence, to direct the cleavage of the target RNA. Without wishing to be bound by theory it is believed that long double stranded RNA introduced into cells is broken down into double stranded short interfering RNAs (siRNAs) comprising a sense strand and an antisense strand by a Type III endonuclease known as Dicer (Sharp et al. (2001) *Genes Dev.* 15:485). Dicer, a ribonuclease-III-like enzyme, processes these dsRNA into 19-23 base pair short interfering RNAs with characteristic two base 3' overhangs (Bernstein, et al., (2001) *Nature* 409:363). These siRNAs are then incorporated into an RNA-induced silencing complex (RISC) where one or more helicases unwind the siRNA duplex, enabling the complementary antisense strand to guide target recognition (Nykanen, et al., (2001) *Cell* 107:309). Upon binding to the appropriate target mRNA, one or more endonucleases within the RISC cleave the target to induce silencing (Elbashir, et al., (2001) *Genes Dev.* 15:188). Thus, in one aspect the invention relates to a single stranded RNA (ssRNA) (the antisense strand of an siRNA duplex) generated within a cell and which promotes the formation of a RISC complex to effect silencing of the target gene, i.e., a C3 gene. Accordingly, the term "siRNA" is also used herein to refer to an RNAi as described above.

In another embodiment, the RNAi agent may be a single-stranded RNA that is introduced into a cell or organism to inhibit a target mRNA. Single-stranded RNAi agents bind to the RISC endonuclease, Argonaute 2, which then cleaves the target mRNA. The single-stranded siRNAs are generally 15-30 nucleotides and are chemically modified. The design and testing of single-stranded RNAs are described in U.S. Pat. No. 8,101,348 and in Lima et al., (2012) *Cell* 150: 883-894, the entire contents of each of which are hereby incorporated herein by reference. Any of the antisense nucleotide sequences described herein may be used as a single-stranded siRNA as described herein or as chemically modified by the methods described in Lima et al., (2012) *Cell* 150:883-894.

In another embodiment, an "iRNA" for use in the compositions, uses, and methods of the invention is a double stranded RNA and is referred to herein as a "double stranded RNAi agent," "double stranded RNA (dsRNA) molecule," "dsRNA agent," or "dsRNA". The term "dsRNA" refers to a complex of ribonucleic acid molecules, having a duplex structure comprising two anti-parallel and substantially complementary nucleic acid strands, referred to as having "sense" and "antisense" orientations with respect to a target RNA, i.e., a C3 gene. In some embodiments of the invention, a double stranded RNA (dsRNA) triggers the degradation of a target RNA, e.g., an mRNA, through a post-transcriptional gene-silencing mechanism referred to herein as RNA interference or RNAi.

In general, the majority of nucleotides of each strand of a dsRNA molecule are ribonucleotides, but as described in detail herein, each or both strands can also include one or more non-ribonucleotides, e.g., a deoxyribonucleotide and/or a modified nucleotide. In addition, as used in this specification, an "RNAi agent" may include ribonucleotides with chemical modifications. Such modifications may include all types of modifications disclosed herein or known in the art. Any such modification, as used in an RNAi agent are encompassed by iRNA for the purposes of the specification and claims. In some embodiments, an RNAi agent includes substantial modifications at multiple nucleotides.

As used herein, the term "modified nucleotide" refers to a nucleotide having, independently, a modified sugar moiety, a modified internucleotide linkage, and/or a modified nucleobase. Thus, the term modified nucleotide encompasses substitutions, additions or removal of, e.g., a functional group or atom, to internucleoside linkages, sugar moieties, or nucleobases. The modifications suitable for use in the agents of the invention include all types of modifications disclosed herein or known in the art. Any such modifications, as used in a siRNA type molecule, are encompassed by "RNAi agent" for the purposes of this specification and claims.

The duplex region may be of any length that permits specific degradation of a desired target RNA through a RISC pathway, and may range from about 9 to 36 base pairs in length, e.g., about 15-30 base pairs in length, for example, about 9, 10, 11, 12, 13, 14, 15, 16, 17, 18, 19, 20, 21, 22, 23, 24, 25, 26, 27, 28, 29, 30, 31, 32, 33, 34, 35, or 36 base pairs in length, such as about 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. Ranges and lengths intermediate to the above recited ranges and lengths are also contemplated to be part of the invention.

The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5'-end of the respective other strand forming the duplex structure, the connecting RNA chain is referred to as a "hairpin loop." A hairpin loop can comprise at least one unpaired nucleotide. In some embodiments, the hairpin loop can comprise at least 2, at least 3, at least 4, at least 5, at least 6, at least 7, at least 8, at least 9, at least 10, at least 20, at least 23 or more unpaired nucleotides. In some embodiments, the hairpin loop can be 10 or fewer nucleotides. In some embodiments, the hairpin loop can be 8 or fewer unpaired nucleotides. In some embodiments, the hairpin loop can be 4-10 unpaired nucleotides. In some embodiments, the hairpin loop can be 4-8 nucleotides.

Where the two substantially complementary strands of a dsRNA are comprised of separate RNA molecules, those molecules need not, but can be covalently connected. Where the two strands are connected covalently by means other than an uninterrupted chain of nucleotides between the 3'-end of one strand and the 5'-end of the respective other strand forming the duplex structure, the connecting structure is referred to as a "linker." The RNA strands may have the same or a different number of nucleotides. The maximum number of base pairs is the number of nucleotides in the shortest strand of the dsRNA minus any overhangs that are present in the duplex. In addition to the duplex structure, an RNAi may comprise one or more nucleotide overhangs. In one embodiment of the RNAi agent, at least one strand comprises a 3' overhang of at least 1 nucleotide. In another embodiment, at least one strand comprises a 3' overhang of at least 2 nucleotides, e.g., 2, 3, 4, 5, 6, 7, 9, 10, 11, 12, 13, 14, or 15 nucleotides. In other embodiments, at least one strand of the RNAi agent comprises a 5' overhang of at least 1 nucleotide. In certain embodiments, at least one strand comprises a 5' overhang of at least 2 nucleotides, e.g., 2, 3, 4, 5, 6, 7, 9, 10, 11, 12, 13, 14, or 15 nucleotides. In still other embodiments, both the 3' and the 5' end of one strand of the RNAi agent comprise an overhang of at least 1 nucleotide.

In one embodiment, an RNAi agent of the invention is a dsRNA agent, each strand of which comprises 19-23 nucleotides that interacts with a target RNA sequence, i.e., a C3 target mRNA sequence, to direct the cleavage of the target RNA. Without wishing to be bound by theory, long double stranded RNA introduced into cells is broken down into siRNA by a Type III endonuclease known as Dicer (Sharp et al. (2001) *Genes Dev.* 15:485). Dicer, a ribonuclease-III-like enzyme, processes the dsRNA into 19-23 base pair short interfering RNAs with characteristic two base 3' overhangs (Bernstein, et al., (2001) *Nature* 409:363). The siRNAs are then incorporated into an RNA-induced silencing complex (RISC) where one or more helicases unwind the siRNA duplex, enabling the complementary antisense strand to guide target recognition (Nykanen, et al., (2001) *Cell* 107: 309). Upon binding to the appropriate target mRNA, one or more endonucleases within the RISC cleave the target to induce silencing (Elbashir, et al., (2001) *Genes Dev.* 15:188). In one embodiment, an RNAi agent of the invention is a dsRNA of 24-30 nucleotides that interacts with a target RNA sequence, i.e., a C3 target mRNA sequence, to direct the cleavage of the target RNA.

As used herein, the term "nucleotide overhang" refers to at least one unpaired nucleotide that protrudes from the duplex structure of an iRNA, e.g., a dsRNA. For example, when a 3'-end of one strand of a dsRNA extends beyond the 5'-end of the other strand, or vice versa, there is a nucleotide overhang. A dsRNA can comprise an overhang of at least one nucleotide; alternatively the overhang can comprise at least two nucleotides, at least three nucleotides, at least four nucleotides, at least five nucleotides or more. A nucleotide overhang can comprise or consist of a nucleotide/nucleoside analog, including a deoxynucleotide/nucleoside. The overhang(s) can be on the sense strand, the antisense strand or any combination thereof. Furthermore, the nucleotide(s) of an overhang can be present on the 5'-end, 3'-end or both ends of either an antisense or sense strand of a dsRNA. In one embodiment of the dsRNA, at least one strand comprises a 3' overhang of at least 1 nucleotide. In another embodiment, at least one strand comprises a 3' overhang of at least 2 nucleotides, e.g., 2, 3, 4, 5, 6, 7, 9, 10, 11, 12, 13, 14, or 15 nucleotides. In other embodiments, at least one strand of the RNAi agent comprises a 5' overhang of at least 1 nucleotide. In certain embodiments, at least one strand comprises a 5' overhang of at least 2 nucleotides, e.g., 2, 3, 4, 5, 6, 7, 9, 10, 11, 12, 13, 14, or 15 nucleotides. In still other embodiments, both the 3' and the 5' end of one strand of the RNAi agent comprise an overhang of at least 1 nucleotide.

In certain embodiments, the antisense strand of a dsRNA has a 1-10 nucleotide, e.g., 0-3, 1-3, 2-4, 2-5, 4-10, 5-10, e.g., a 1, 2, 3, 4, 5, 6, 7, 8, 9, or 10 nucleotide, overhang at the 3'-end and/or the 5'-end. In one embodiment, the sense strand of a dsRNA has a 1-10 nucleotide, e.g., a 1, 2, 3, 4, 5, 6, 7, 8, 9, or 10 nucleotide, overhang at the 3'-end and/or the 5'-end. In another embodiment, one or more of the nucleotides in the overhang is replaced with a nucleoside thiophosphate.

In certain embodiments, the overhang on the sense strand or the antisense strand, or both, can include extended lengths longer than 10 nucleotides, e.g., 1-30 nucleotides, 2-30 nucleotides, 10-30 nucleotides, or 10-15 nucleotides in length. In certain embodiments, an extended overhang is on the sense strand of the duplex. In certain embodiments, an extended overhang is present on the 3'end of the sense strand of the duplex. In certain embodiments, an extended overhang is present on the 5'end of the sense strand of the duplex. In certain embodiments, an extended overhang is on the antisense strand of the duplex. In certain embodiments, an extended overhang is present on the 3'end of the antisense strand of the duplex. In certain embodiments, an extended overhang is present on the 5'end of the antisense strand of the duplex. In certain embodiments, one or more of the nucleotides in the overhang is replaced with a nucleoside thiophosphate. In certain embodiments, the overhang includes a self-complementary portion such that the overhang is capable of forming a hairpin structure that is stable under physiological conditions.

"Blunt" or "blunt end" means that there are no unpaired nucleotides at that end of the double stranded RNAi agent, i.e., no nucleotide overhang. A "blunt ended" RNAi agent is a dsRNA that is double stranded over its entire length, i.e., no nucleotide overhang at either end of the molecule. The RNAi agents of the invention include RNAi agents with nucleotide overhangs at one end (i.e., agents with one overhang and one blunt end) or with nucleotide overhangs at both ends.

The term "antisense strand" or "guide strand" refers to the strand of an iRNA, e.g., a dsRNA, which includes a region that is substantially complementary to a target sequence, e.g., a C3 mRNA. As used herein, the term "region of complementarity" refers to the region on the antisense strand that is substantially complementary to a sequence, for example a target sequence, e.g., a C3 nucleotide sequence, as defined herein. Where the region of complementarity is not fully complementary to the target sequence, the mismatches can be in the internal or terminal regions of the molecule. Generally, the most tolerated mismatches are in the terminal regions, e.g., within 5, 4, 3, 2, or 1 nucleotides of the 5'- and/or 3'-terminus of the iRNA. In one embodiment, a double stranded RNAi agent of the invention includes a nucleotide mismatch in the anti sense strand. In another embodiment, a double stranded RNAi agent of the invention includes a nucleotide mismatch in the sense strand. In one embodiment, the nucleotide mismatch is, for example, within 5, 4, 3, 2, or 1 nucleotides from the 3'-terminus of the iRNA. In another embodiment, the nucleotide mismatch is, for example, in the 3'-terminal nucleotide of the iRNA.

The term "sense strand" or "passenger strand" as used herein, refers to the strand of an iRNA that includes a region that is substantially complementary to a region of the antisense strand as that term is defined herein.

As used herein, the term "cleavage region" refers to a region that is located immediately adjacent to the cleavage site. The cleavage site is the site on the target at which cleavage occurs. In some embodiments, the cleavage region comprises three bases on either end of, and immediately adjacent to, the cleavage site. In some embodiments, the cleavage region comprises two bases on either end of, and immediately adjacent to, the cleavage site. In some embodiments, the cleavage site specifically occurs at the site bound by nucleotides 10 and 11 of the antisense strand, and the cleavage region comprises nucleotides 11, 12 and 13.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions can include: 400 mM NaCl, 40 mM PIPES pH 6.4, 1 mM EDTA, 50° C. or 70° C. for 12-16 hours followed by washing (see, e.g., "Molecular Cloning: A Laboratory Manual, Sambrook, et al. (1989) Cold Spring Harbor Laboratory Press). Other conditions, such as physiologically relevant conditions as can be encountered inside an organism, can apply. The skilled person will be able to determine the set of conditions most appropriate for a test of complementarity of two sequences in accordance with the ultimate application of the hybridized nucleotides.

Complementary sequences within an iRNA, e.g., within a dsRNA as described herein, include base-pairing of the oligonucleotide or polynucleotide comprising a first nucleotide sequence to an oligonucleotide or polynucleotide comprising a second nucleotide sequence over the entire length of one or both nucleotide sequences. Such sequences can be referred to as "fully complementary" with respect to each other herein. However, where a first sequence is referred to as "substantially complementary" with respect to a second sequence herein, the two sequences can be fully complementary, or they can form one or more, but generally not more than 5, 4, 3 or 2 mismatched base pairs upon hybridization for a duplex up to 30 base pairs, while retaining the ability to hybridize under the conditions most relevant to their ultimate application, e.g., inhibition of gene expression via a RISC pathway. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, can yet be referred to as "fully complementary" for the purposes described herein.

"Complementary" sequences, as used herein, can also include, or be formed entirely from, non-Watson-Crick base pairs and/or base pairs formed from non-natural and modified nucleotides, in so far as the above requirements with respect to their ability to hybridize are fulfilled. Such non-Watson-Crick base pairs include, but are not limited to, G:U Wobble or Hoogstein base pairing.

The terms "complementary," "fully complementary" and "substantially complementary" herein can be used with respect to the base matching between the sense strand and the antisense strand of a dsRNA, or between the antisense strand of an iRNA agent and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of interest (i.e., a C3 gene). For example, a polynucleotide is complementary to at least a part of a C3 mRNA if the sequence is substantially complementary to a non-interrupted portion of an mRNA encoding C3.

Accordingly, in some embodiments, the sense strand polynucleotides and the antisense polynucleotides disclosed herein are fully complementary to the target C3 gene sequence.

In one embodiment, the antisense polynucleotides disclosed herein are fully complementary to the target C3 sequence. In other embodiments, the antisense polynucleotides disclosed herein are substantially complementary to the target C3 sequence and comprise a contiguous nucleotide sequence which is at least about 80% complementary over its entire length to the equivalent region of the nucleotide sequence of any one of SEQ ID NO:1, or a fragment of any one of SEQ ID NO:1, such as about 85%, about 86%, about 87%, about 88%, about 89%, about 90%, about % 91%, about 92%, about 93%, about 94%, about 95%, about 96%, about 97%, about 98%, or about 99% complementary.

In other embodiments, the antisense polynucleotides disclosed herein are substantially complementary to the target C3 sequence and comprise a contiguous nucleotide sequence which is at least about 80% complementary over its entire length to any one of the sense strand nucleotide sequences in any one of Tables 3, 4, 6, 7, and 9, or a fragment of any one of the sense strand nucleotide sequences in any one of Tables 3, 4, 6, 7, and 9, such as about 85%, about 86%, about 87%, about 88%, about 89%, about 90%, about % 91%, about 92%, about 93%, about 94%, about 95%, about 96%, about 97%, about 98%, or about 99% complementary.

In one embodiment, an RNAi agent of the invention includes a sense strand that is substantially complementary to an antisense polynucleotide which, in turn, is complementary to a target C3 sequence and comprises a contiguous nucleotide sequence which is at least about 80% complementary over its entire length to any one of the sense strand nucleotide sequences in any one of Tables 3, 4, 6, 7, and 9, or a fragment of any one of the sense strand nucleotide sequences in any one of Tables 3, 4, 6, 7, and 9, such as about 85%, about 86%, about 87%, about 88%, about 89%, about 90%, about % 91%, about 92%, about 93%, about 94%, about 95%, about 96%, about 97%, about 98%, or about 99% complementary.

In one aspect of the invention, an agent for use in the methods and compositions of the invention is a single-stranded antisense RNA molecule that inhibits a target mRNA via an antisense inhibition mechanism. The single-stranded antisense RNA molecule is complementary to a sequence within the target mRNA. The single-stranded antisense oligonucleotides can inhibit translation in a stoichiometric manner by base pairing to the mRNA and physically obstructing the translation machinery, see Dias, N. et al., (2002) *Mol Cancer Ther* 1:347-355. The single-stranded antisense RNA molecule may be about 15 to about 30 nucleotides in length and have a sequence that is complementary to a target sequence. For example, the single-stranded antisense RNA molecule may comprise a sequence that is at least about 15, 16, 17, 18, 19, 20, or more contiguous nucleotides from any one of the antisense sequences described herein.

As used herein, the term "complement component C3-associated disease" is a disease or disorder that is caused by, or associated with complement activation. The term "complement component C3-associated disease" includes a disease, disorder or condition that would benefit from reduction in C3 expression. Such diseases are typically associated with inflammation and/or immune system activation, e.g., membrane attack complex-mediated lysis, anaphylaxis, and/or hemolysis. Non-limiting examples of complement component C3-associated diseases include paroxysmal nocturnal hemoglobinuria (PNH), atypical hemolytic uremic syndrome (aHUS), asthma, rheumatoid arthritis (RA); antiphospholipid antibody syndrome; lupus nephritis; ischemia-reperfusion injury; typical or infectious hemolytic uremic syndrome (tHUS); dense deposit disease (DDD); neuromyelitis optica (NMO), multifocal motor neuropathy (MMN); multiple sclerosis (MS); macular degeneration (e.g., age-related macular degeneration (AMD)); systemic lupus erythmatosis; hemolysis, elevated liver enzymes, and low platelets (HELLP) syndrome; thrombotic thrombocytopenic purpura (TTP); spontaneous fetal loss; Pauci-immune vasculitis; epidermolysis bullosa; recurrent fetal loss; pre-eclampsia, traumatic brain injury, myasthenia gravis, cold agglutinin disease, dermatomyositis bullous pemphigoid, Shiga toxin *E. coli*-related hemolytic uremic syndrome, C3 neuropathy, anti-neutrophil cytoplasmic antibody-associated vasculitis (e.g., granulomatosis with polyangiitis (previously known as Wegener granulomatosis), Churg-Strauss syndrome, and microscopic polyangiitis), humoral and vascular transplant rejection, graft dysfunction, myocardial infarction (e.g., tissue damage and ischemia in myocardial infarction), an allogenic transplant, sepsis (e.g., poor outcome in sepsis), Coronary artery disease, dermatomyositis, Graves' disease, atherosclerosis, Alzheimer's disease, systemic inflammatory response sepsis, septic shock, spinal cord injury, glomerulonephritis, Hashimoto's thyroiditis, type I diabetes, psoriasis, pemphigus, autoimmune hemolytic anemia (AIHA), ITP, Goodpasture syndrome, Degos disease, antiphospholipid syndrome (APS), catastrophic APS (CAPS), a cardiovascular disorder, myocarditis, a cerebrovascular disorder, a peripheral (e.g., musculoskeletal) vascular disorder, a renovascular disorder, a mesenteric/enteric vascular disorder, vasculitis, Henoch-Schönlein purpura nephritis, systemic lupus erythematosus-associated vasculitis, vasculitis associated with rheumatoid arthritis, immune complex vasculitis, Takayasu's disease, dilated cardiomyopathy, diabetic angiopathy, Kawasaki's disease (arteritis), venous gas embolus (VGE), and restenosis following stent placement, rotational atherectomy, and percutaneous transluminal coronary angioplasty (PTCA) (see, e.g., Holers (2008) *Immunological Reviews* 223:300-316; Holers and Thurman (2004) *Molecular Immunology* 41:147-152; U.S. Patent Publication No. 20070172483).

"Therapeutically effective amount," as used herein, is intended to include the amount of an RNAi agent that, when administered to a subject having a complement component C3-associated disease, is sufficient to effect treatment of the disease (e.g., by diminishing, ameliorating or maintaining the existing disease or one or more symptoms of disease). The "therapeutically effective amount" may vary depending on the RNAi agent or antibody, or antigen-binding fragment thereof, how the agent is administered, the disease and its severity and the history, age, weight, family history, genetic makeup, the types of preceding or concomitant treatments, if any, and other individual characteristics of the subject to be treated.

"Prophylactically effective amount," as used herein, is intended to include the amount of an iRNA agent that, when administered to a subject having a complement component-associate disease but not yet (or currently) experiencing or displaying symptoms of the disease, and/or a subject at risk of developing a complement component C3-associated disease, e.g., a subject having a graft and/or transplant, e.g., a sensitized or allogenic recipient, a subject having sepsis, and/or a subject having a myocardial infarction, is sufficient to prevent or ameliorate the disease or one or more symptoms of the disease. Ameliorating the disease includes slowing the course of the disease or reducing the severity of later-developing disease. The "prophylactically effective amount" may vary depending on the iRNA agent, how the agent is administered, the degree of risk of disease, and the history, age, weight, family history, genetic makeup, the types of preceding or concomitant treatments, if any, and other individual characteristics of the patient to be treated.

A "therapeutically effective amount" or "prophylactically effective amount" also includes an amount of an RNAi agent that produces some desired local or systemic effect at a reasonable benefit/risk ratio applicable to any treatment. iRNA agents employed in the methods of the present invention may be administered in a sufficient amount to produce a reasonable benefit/risk ratio applicable to such treatment.

As used herein, a "subject" is an animal, such as a mammal, including a primate (such as a human, a non-human primate, e.g., a monkey, and a chimpanzee), a non-primate (such as a cow, a pig, a camel, a llama, a horse, a goat, a rabbit, a sheep, a hamster, a guinea pig, a cat, a dog, a rat, a mouse, a horse, and a whale), or a bird (e.g., a duck or a goose). In an embodiment, the subject is a human, such as a human being treated or assessed for a disease, disorder or condition that would benefit from reduction in C3 expression; a human at risk for a disease, disorder or condition that would benefit from reduction in C3 expression; a human having a disease, disorder or condition that would benefit from reduction in C3 expression; and/or human being treated for a disease, disorder or condition that would benefit from reduction in C3 expression as described herein.

II. iRNAs of the Invention

The present invention provides iRNAs which inhibit the expression of a complement component gene. In one embodiment, the iRNA agent includes double stranded ribonucleic acid (dsRNA) molecules for inhibiting the expression of a C3 gene in a cell, such as a cell within a subject, e.g., a mammal, such as a human having a complement component C3-associated disease as described herein, e.g., paroxysmal nocturnal hemoglobinuria (PNH), atypical hemolytic uremic syndrome (aHUS), neuromyelitis optica (NMO), multifocal motor neuropathy (MMN), myasthenia gravis (MG), C3 glomerulonephritis, or systemic lupus erythmatosis. The dsRNA includes an antisense strand having a region of complementarity which is complementary to at least a part of an mRNA formed in the expression of a target gene, i.e., C3 gene. The region of complementarity is about 30 nucleotides or less in length (e.g., about 30, 29, 28, 27, 26, 25, 24, 23, 22, 21, 20, 19, or 18 nucleotides or less in length). Upon contact with a cell expressing the target gene, the iRNA selectively inhibits the expression of the target gene (e.g., a human, a primate, a non-primate, or a bird C3 gene) by at least about 10%, by at least 30%, preferably at least 50% as assayed by, for example, a PCR or branched DNA (bDNA)-based method, or by a protein-based method, such as by immunofluorescence analysis, using, for example, western blotting or flow cytometric techniques. In preferred embodiments, inhibition of expression is determined by the qPCR method provided in the examples. For in vitro assessment of activity, percent inhibition is determined using the methods provided in Example 2 at a single dose at a 10 nM duplex final concentration. For in vivo studies, the level after treatment can be compared to, for example, an appropriate historical control or a pooled population sample control to determine the level of reduction, e.g., when a baseline value is no available for the subject.

A dsRNA includes two RNA strands that are complementary and hybridize to form a duplex structure under conditions in which the dsRNA will be used. One strand of a dsRNA (the antisense strand) includes a region of complementarity that is substantially complementary, and generally fully complementary, to a target sequence. The target sequence can be derived from the sequence of an mRNA formed during the expression of a C3 gene. The other strand (the sense strand) includes a region that is complementary to the antisense strand, such that the two strands hybridize and form a duplex structure when combined under suitable conditions. As described elsewhere herein and as known in the art, the complementary sequences of a dsRNA can also be contained as self-complementary regions of a single nucleic acid molecule, as opposed to being on separate oligonucleotides.

Generally, the duplex structure is between 15 and 30 base pairs in length, e.g., between, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. Ranges and lengths intermediate to the above recited ranges and lengths are also contemplated to be part of the invention.

Similarly, the region of complementarity to the target sequence is between 15 and 30 nucleotides in length, e.g., between 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. Ranges and lengths intermediate to the above recited ranges and lengths are also contemplated to be part of the invention.

In some embodiments, the sense and antisense strands of the dsRNA are each independently about 15 to about 30 nucleotides in length, or about 25 to about 30 nucleotides in length, e.g., each strand is independently between 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length.

In one embodiment, an RNAi agent of the invention is a dsRNA of 24-30 nucleotides that interacts with a target RNA sequence, i.e., a C3 target mRNA sequence, to direct the cleavage of the target RNA. In general, the dsRNA is long enough to serve as a substrate for the Dicer enzyme. For example, it is well-known in the art that dsRNAs longer than about 21-23 nucleotides in length may serve as substrates for Dicer. As the ordinarily skilled person will also recognize, the region of an RNA targeted for cleavage will most often be part of a larger RNA molecule, often an mRNA molecule. Where relevant, a "part" of an mRNA target is a contiguous sequence of an mRNA target of sufficient length to allow it to be a substrate for RNAi-directed cleavage (i.e., cleavage through a RISC pathway).

One of skill in the art will also recognize that the duplex region is a primary functional portion of a dsRNA, e.g., a duplex region of about 9 to 36 base pairs, e.g., about 10-36, 11-36, 12-36, 13-36, 14-36, 15-36, 9-35, 10-35, 11-35, 12-35, 13-35, 14-35, 15-35, 9-34, 10-34, 11-34, 12-34, 13-34, 14-34, 15-34, 9-33, 10-33, 11-33, 12-33, 13-33, 14-33, 15-33, 9-32, 10-32, 11-32, 12-32, 13-32, 14-32, 15-32, 9-31, 10-31, 11-31, 12-31, 13-32, 14-31, 15-31, 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs. Thus, in one embodiment, to the extent that it becomes processed to a functional duplex, of e.g., 15-30 base pairs, that targets a desired RNA for cleavage, an RNA molecule or complex of RNA molecules having a duplex region greater than 30 base pairs is a dsRNA. Thus, an ordinarily skilled artisan will recognize that in one embodiment, a miRNA is a dsRNA. In another embodiment, a dsRNA is not a naturally occurring miRNA. In another embodiment, an iRNA agent useful to target C3 expression is not generated in the target cell by cleavage of a larger dsRNA.

A dsRNA as described herein can further include one or more single-stranded nucleotide overhangs e.g., 1, 2, 3, or 4 nucleotides. dsRNAs having at least one nucleotide overhang can have unexpectedly superior inhibitory properties relative to their blunt-ended counterparts. A nucleotide overhang can comprise or consist of a nucleotide/nucleoside analog, including a deoxynucleotide/nucleoside. The overhang(s) can be on the sense strand, the antisense strand or any combination thereof. Furthermore, the nucleotide(s) of an overhang can be present on the 5'-end, 3'-end or both ends of either an antisense or sense strand of a dsRNA. In certain embodiments, longer, extended overhangs are possible.

A dsRNA can be synthesized by standard methods known in the art as further discussed below, e.g., by use of an automated DNA synthesizer, such as are commercially available from, for example, Biosearch, Applied Biosystems, Inc.

iRNA compounds of the invention may be prepared using a two-step procedure. First, the individual strands of the double stranded RNA molecule are prepared separately. Then, the component strands are annealed. The individual strands of the siRNA compound can be prepared using solution-phase or solid-phase organic synthesis or both. Organic synthesis offers the advantage that the oligonucleotide strands comprising unnatural or modified nucleotides can be easily prepared. Single-stranded oligonucleotides of the invention can be prepared using solution-phase or solid-phase organic synthesis or both.

In one aspect, a dsRNA of the invention includes at least two nucleotide sequences, a sense sequence and an antisense sequence.

In one embodiment, the sense strand is selected from the group of sequences provided in any one of Tables 3, 4, 6, 7, and 9, and the corresponding antisense strand of the sense strand is selected from the group of sequences of any one of Tables 3, 4, 6, 7, and 9. In this aspect, one of the two sequences is complementary to the other of the two sequences, with one of the sequences being substantially complementary to a sequence of an mRNA generated in the expression of a C3 gene. As such, in this aspect, a dsRNA will include two oligonucleotides, where one oligonucleotide is described as the sense strand in any one of Tables 3, 4, 6, 7, and 9 and the second oligonucleotide is described as the corresponding antisense strand of the sense strand in any one of Tables 3, 4, 6, 7, and 9. In one embodiment, the substantially complementary sequences of the dsRNA are contained on separate oligonucleotides. In another embodiment, the substantially complementary sequences of the dsRNA are contained on a single oligonucleotide.

It will be understood that, although some of the sequences in any one of Tables 3, 4, 6, 7, and 9 are described as modified and/or conjugated sequences, the RNA of the iRNA of the invention e.g., a dsRNA of the invention, may comprise any one of the sequences set forth in any one of Tables 3, 4, 6, 7, and 9 that is un-modified, un-conjugated, and/or modified and/or conjugated differently than described therein.

The skilled person is well aware that dsRNAs having a duplex structure of between about 20 and 23 base pairs, e.g., 21, base pairs have been hailed as particularly effective in inducing RNA interference (Elbashir et al., *EMBO* 2001, 20:6877-6888). However, others have found that shorter or longer RNA duplex structures can also be effective (Chu and Rana (2007) *RNA* 14:1714-1719; Kim et al. (2005) *Nat Biotech* 23:222-226). In the embodiments described above, by virtue of the nature of the oligonucleotide sequences provided in any one of any one of Tables 3, 4, 6, 7, and 9 dsRNAs described herein can include at least one strand of a length of minimally 21 nucleotides. It can be reasonably expected that shorter duplexes having one of the sequences of any one of Tables 3, 4, 6, 7, and 9 minus only a few nucleotides on one or both ends can be similarly effective as compared to the dsRNAs described above. Hence, dsRNAs having a sequence of at least 15, 16, 17, 18, 19, 20, or more contiguous nucleotides derived from one of the sequences of any one of Tables 3, 4, 6, 7, and 9, and differing in their ability to inhibit the expression of the target gene by not more than about 5, 10, 15, 20, 25, or 30% inhibition from a dsRNA comprising the full sequence, are contemplated to be within the scope of the present invention.

In addition, the RNAs provided in any one of Tables 3, 4, 6, 7, and 9 identify a site(s) in a C3 transcript that is susceptible to RISC-mediated cleavage. As such, the present invention further features iRNAs that target within one of these sites. As used herein, an iRNA is said to target within a particular site of an RNA transcript if the iRNA promotes cleavage of the transcript anywhere within that particular site. Such an iRNA will generally include at least about 15 contiguous nucleotides from one of the sequences provided in any one of Tables 3, 4, 6, 7, and 9 coupled to additional nucleotide sequences taken from the region contiguous to the selected sequence in the target gene.

While a target sequence is generally about 15-30 nucleotides in length, there is wide variation in the suitability of particular sequences in this range for directing cleavage of any given target RNA. Various software packages and the guidelines set out herein provide guidance for the identification of optimal target sequences for any given gene target, but an empirical approach can also be taken in which a "window" or "mask" of a given size (as a non-limiting example, 21 nucleotides) is literally or figuratively (including, e.g., in silico) placed on the target RNA sequence to identify sequences in the size range that can serve as target sequences. By moving the sequence "window" progressively one nucleotide upstream or downstream of an initial target sequence location, the next potential target sequence can be identified, until the complete set of possible sequences is identified for any given target size selected. This process, coupled with systematic synthesis and testing of the identified sequences (using assays as described herein or as known in the art) to identify those sequences that perform optimally can identify those RNA sequences that, when targeted with an iRNA agent, mediate the best inhibition of target gene expression. Thus, while the sequences identified, for example, in any one of Tables 3, 4, 6, 7, and 9 represent effective target sequences, it is contemplated that further optimization of inhibition efficiency can be achieved by progressively "walking the window" one nucleotide upstream or downstream of the given sequences to identify sequences with equal or better inhibition characteristics.

Further, it is contemplated that for any sequence identified, e.g., in any one of Tables 3, 4, 6, 7, and 9, further optimization could be achieved by systematically either adding or removing nucleotides to generate longer or shorter sequences and testing those sequences generated by walking a window of the longer or shorter size up or down the target RNA from that point. Again, coupling this approach to generating new candidate targets with testing for effectiveness of iRNAs based on those target sequences in an inhibition assay as known in the art and/or as described herein can lead to further improvements in the efficiency of inhibition. Further still, such optimized sequences can be adjusted by, e.g., the introduction of modified nucleotides as described herein or as known in the art, addition or changes in overhang, or other modifications as known in the art and/or discussed herein to further optimize the molecule (e.g., increasing serum stability or circulating half-life, increasing thermal stability, enhancing transmembrane delivery, targeting to a particular location or cell type, increasing interaction with silencing pathway enzymes, increasing release from endosomes) as an expression inhibitor.

An iRNA as described herein can contain one or more mismatches to the target sequence. In one embodiment, an iRNA as described herein contains no more than 3 mismatches. If the antisense strand of the iRNA contains mismatches to a target sequence, it is preferable that the area of mismatch is not located in the center of the region of complementarity. If the antisense strand of the iRNA contains mismatches to the target sequence, it is preferable that the mismatch be restricted to be within the last 5 nucleotides from either the 5'- or 3'-end of the region of complementarity. For example, for a 23 nucleotide iRNA agent the strand which is complementary to a region of, e.g., a C3 gene, generally does not contain any mismatch within the central 13 nucleotides. The methods described herein or methods known in the art can be used to determine whether an iRNA containing a mismatch to a target sequence is effective in inhibiting the expression of a target gene, e.g., a C3 gene. Consideration of the efficacy of iRNAs with mismatches in inhibiting expression of a target gene is important, especially if the particular region of complementarity in a target gene is known to have polymorphic sequence variation within the population.

III. Modified iRNAs of the Invention

In one embodiment, the RNA of the iRNA of the invention e.g., a dsRNA, is un-modified, and does not comprise, e.g., chemical modifications and/or conjugations known in the art and described herein. In another embodiment, the RNA of an iRNA of the invention, e.g., a dsRNA, is chemically modified to enhance stability or other beneficial characteristics. In certain embodiments of the invention, substantially all of the nucleotides of an iRNA of the invention are modified. In other embodiments of the invention, all of the nucleotides of an iRNA of the invention are modified iRNAs of the invention in which "substantially all of the nucleotides are modified" are largely but not wholly modified and can include not more than 5, 4, 3, 2, or 1 unmodified nucleotides.

The nucleic acids featured in the invention can be synthesized and/or modified by methods well established in the art, such as those described in "Current protocols in nucleic acid chemistry," Beaucage, S. L. et al. (Edrs.), John Wiley & Sons, Inc., New York, N.Y., USA, which is hereby incorporated herein by reference. Modifications include, for example, end modifications, e.g., 5'-end modifications (phosphorylation, conjugation, inverted linkages) or 3'-end modifications (conjugation, DNA nucleotides, inverted linkages, etc.); base modifications, e.g., replacement with stabilizing bases, destabilizing bases, or bases that base pair with an expanded repertoire of partners, removal of bases (abasic nucleotides), or conjugated bases; sugar modifications (e.g., at the 2'-position or 4'-position) or replacement of the sugar; and/or backbone modifications, including modification or replacement of the phosphodiester linkages. Specific examples of iRNA compounds useful in the embodiments described herein include, but are not limited to RNAs containing modified backbones or no natural internucleoside linkages. RNAs having modified backbones include, among others, those that do not have a phosphorus atom in the backbone. For the purposes of this specification, and as sometimes referenced in the art, modified RNAs that do not have a phosphorus atom in their internucleoside backbone can also be considered to be oligonucleosides. In some embodiments, a modified iRNA will have a phosphorus atom in its internucleoside backbone.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5'-linked analogs of these, and those having inverted polarity wherein the adjacent pairs of nucleoside units are linked 3'-5' to 5'-3' or 2'-5' to 5'-2'. Various salts, mixed salts and free acid forms are also included. In some embodiments of the invention, the dsRNA agents of the invention are in a free acid form. In other embodiments of the invention, the dsRNA agents of the invention are in a salt form. In one embodiment, the dsRNA agents of the invention are in a sodium salt form. In certain embodiments, when the dsRNA agents of the invention are in the sodium salt form, sodium ions are present in the agent as counterions for substantially all of the phosphodiester and/or phosphorothioate groups present in the agent. Agents in which substantially all of the phosphodiester and/or phosphorothioate linkages have a sodium counterion include not more than 5, 4, 3, 2, or 1 phosphodiester and/or phosphorothioate linkages without a sodium counterion. In some embodiments, when the dsRNA agents of the invention are in the sodium salt form, sodium ions are present in the agent as counterions for all of the phosphodiester and/or phosphorothioate groups present in the agent.

Representative U.S. patents that teach the preparation of the above phosphorus-containing linkages include, but are not limited to, U.S. Pat. Nos. 3,687,808; 4,469,863; 4,476, 301; 5,023,243; 5,177,195; 5,188,897; 5,264,423; 5,276, 019; 5,278,302; 5,286,717; 5,321,131; 5,399,676; 5,405, 939; 5,453,496; 5,455,233; 5,466,677; 5,476,925; 5,519, 126; 5,536,821; 5,541,316; 5,550,111; 5,563,253; 5,571, 799; 5,587,361; 5,625,050; 6,028,188; 6,124,445; 6,160, 109; 6,169,170; 6,172,209; 6,239,265; 6,277,603; 6,326, 199; 6,346,614; 6,444,423; 6,531,590; 6,534,639; 6,608, 035; 6,683,167; 6,858,715; 6,867,294; 6,878,805; 7,015, 315; 7,041,816; 7,273,933; 7,321,029; and U.S. Pat. No. RE39464, the entire contents of each of which are hereby incorporated herein by reference.

Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and, 5,677,439, the entire contents of each of which are hereby incorporated herein by reference.

In other embodiments, suitable RNA mimetics are contemplated for use in iRNAs, in which both the sugar and the internucleoside linkage, i.e., the backbone, of the nucleotide units are replaced with novel groups. The base units are maintained for hybridization with an appropriate nucleic acid target compound. One such oligomeric compound, an RNA mimetic that has been shown to have excellent hybridization properties, is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone. Representative U.S. patents that teach the preparation of PNA compounds include, but are not limited to, U.S. Pat. Nos. 5,539,082; 5,714,331; and 5,719,262, the entire contents of each of which are hereby incorporated herein by reference. Additional PNA compounds suitable for use in the iRNAs of the invention are described in, for example, in Nielsen et al., Science, 1991, 254, 1497-1500.

Some embodiments featured in the invention include RNAs with phosphorothioate backbones and oligonucleosides with heteroatom backbones, and in particular —$CH_2$—NH—$CH_2$—, —$CH_2$—N($CH_3$)—O—$CH_2$—[known as a methylene (methylimino) or MMI backbone], —$CH_2$—O—N($CH_3$)—$CH_2$—, —$CH_2$—N($CH_3$)—N($CH_3$)—$CH_2$— and —N($CH_3$)—$CH_2$—$CH_2$—[wherein the native phosphodiester backbone is represented as —O—P—O—$CH_2$—] of the above-referenced U.S. Pat. No. 5,489,677, and the amide backbones of the above-referenced U.S. Pat. No. 5,602,240. In some embodiments, the RNAs featured herein have morpholino backbone structures of the above-referenced U.S. Pat. No. 5,034,506.

Modified RNAs can also contain one or more substituted sugar moieties. The iRNAs, e.g., dsRNAs, featured herein can include one of the following at the 2'-position: OH; F; O-, S-, or N-alkyl; O-, S-, or N-alkenyl; O-, S- or N-alkynyl; or O-alkyl-O-alkyl, wherein the alkyl, alkenyl and alkynyl can be substituted or unsubstituted $C_1$ to $C_{10}$ alkyl or $C_2$ to $C_{10}$ alkenyl and alkynyl. Exemplary suitable modifications include O[($CH_2$)$_n$O]$_m$$CH_3$, O($CH_2$)$_n$$OCH_3$, O($CH_2$)$_n$$NH_2$, O($CH_2$)$_n$$CH_3$, O($CH_2$)$_n$$ONH_2$, and O($CH_2$)$_n$ON[($CH_2$)$_n$$CH_3$)]$_2$, where n and m are from 1 to about 10. In other embodiments, dsRNAs include one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an iRNA, or a group for improving the pharmacodynamic properties of an iRNA, and other substituents having similar properties. In some embodiments, the modification includes a 2'-methoxyethoxy (2'-O—$CH_2CH_2OCH_3$, also known as 2'-O-(2-methoxyethyl) or 2'-MOE) (Martin et al., Helv. Chico. Acta, 1995, 78:486-504) i.e., an alkoxy-alkoxy group. Another exemplary modification is 2'-dimethylaminooxyethoxy, i.e., a O($CH_2$)$_2$ON($CH_3$)$_2$ group, also known as 2'-DMAOE, as described in examples herein below, and 2'-dimethylaminoethoxyethoxy (also known in the art as 2'-O-dimethyl aminoethoxyethyl or 2'-DMAEOE), i.e., 2'-O—$CH_2$—O—$CH_2$—N($CH_3$)$_2$.

Other modifications include 2'-methoxy (2'-$OCH_3$), 2'-aminopropoxy (2'-$OCH_2CH_2CH_2NH_2$) and 2'-fluoro (2'-F). Similar modifications can also be made at other positions on the RNA of an iRNA, particularly the 3' position of the sugar on the 3' terminal nucleotide or in 2'-5' linked dsRNAs and the 5' position of 5' terminal nucleotide. iRNAs can also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application. The entire contents of each of the foregoing are hereby incorporated herein by reference.

The RNA of an iRNA of the invention can also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as deoxythymine (dT), 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer Science And Engineering, pages 858-859, Kroschwitz, J. L, ed. John Wiley & Sons, 1990, these disclosed by Englisch et al., Angewandte Chemie, International Edition, 1991, 30, 613, and those disclosed by Sanghvi, Y S., Chapter 15, dsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the invention. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative U.S. patents that teach the preparation of certain of the above noted modified nucleobases as well as other modified nucleobases include, but are not limited to, the above noted U.S. Pat. Nos. 3,687,808, 4,845,205; 5,130, 30; 5,134,066; 5,175,273; 5,367,066; 5,432,272; 5,457,187; 5,459,255; 5,484,908; 5,502,177; 5,525,711; 5,552,540; 5,587,469; 5,594,121, 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, the entire contents of each of which are hereby incorporated herein by reference.

The RNA of an iRNA can also be modified to include one or more locked nucleic acids (LNA). A locked nucleic acid is a nucleotide having a modified ribose moiety in which the ribose moiety comprises an extra bridge connecting the 2' and 4' carbons. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12): 3185-3193).

In some embodiments, the iRNA of the invention comprises one or more monomers that are UNA (unlocked nucleic acid) nucleotides. UNA is unlocked acyclic nucleic acid, wherein any of the bonds of the sugar has been removed, forming an unlocked "sugar" residue. In one example, UNA also encompasses monomer with bonds between C1'-C4' have been removed (i.e. the covalent carbon-oxygen-carbon bond between the C1' and C4' carbons). In another example, the C2'-C3' bond (i.e. the covalent carbon-carbon bond between the C2' and C3' carbons) of the sugar has been removed (see *Nuc. Acids Symp. Series*, 52, 133-134 (2008) and Fluiter et al., *Mol. Biosyst.*, 2009, 10, 1039 hereby incorporated by reference).

The RNA of an iRNA can also be modified to include one or more bicyclic sugar moieties. A "bicyclic sugar" is a furanosyl ring modified by the bridging of two atoms. A "bicyclic nucleoside" ("BNA") is a nucleoside having a sugar moiety comprising a bridge connecting two carbon atoms of the sugar ring, thereby forming a bicyclic ring system. In certain embodiments, the bridge connects the 4'-carbon and the 2'-carbon of the sugar ring. Thus, in some embodiments an agent of the invention may include one or more locked nucleic acids (LNA). A locked nucleic acid is a nucleotide having a modified ribose moiety in which the ribose moiety comprises an extra bridge connecting the 2' and 4' carbons. In other words, an LNA is a nucleotide comprising a bicyclic sugar moiety comprising a 4'-CH$_2$—O-2' bridge. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12):3185-3193). Examples of bicyclic nucleosides for use in the polynucleotides of the invention include without limitation nucleosides comprising a bridge between the 4' and the 2' ribosyl ring atoms. In certain embodiments, the antisense polynucleotide agents of the invention include one or more bicyclic nucleosides comprising a 4' to 2' bridge. Examples of such 4' to 2' bridged bicyclic nucleosides, include but are not limited to 4'-(CH2)-O-2' (LNA); 4'-(CH2)-S-2; 4'-(CH2)2-O-2' (ENA); 4'-CH(CH3)-O-2' (also referred to as "constrained ethyl" or "cEt") and 4'-CH(CH2OCH3)-O-2' (and analogs thereof; see, e.g., U.S. Pat. No. 7,399,845); 4'-C(CH3)(CH3)-O-2' (and analogs thereof; see e.g., U.S. Pat. No. 8,278,283); 4'-CH2-N(OCH3)-2' (and analogs thereof; see e.g., U.S. Pat. No. 8,278,425); 4'-CH2-O—N(CH3)-2' (see, e.g., U.S. Patent Publication No. 2004/0171570); 4'-CH2-N(R)—O-2', wherein R is H, C1-C12 alkyl, or a protecting group (see, e.g., U.S. Pat. No. 7,427,672); 4'-CH2-C(H)(CH3)-2' (see, e.g., Chattopadhyaya et al., *J. Org. Chem.*, 2009, 74, 118-134); and 4'-CH2-C(=CH2)-2' (and analogs thereof; see, e.g., U.S. Pat. No. 8,278,426). The entire contents of each of the foregoing are hereby incorporated herein by reference.

Additional representative U.S. Patents and US Patent Publications that teach the preparation of locked nucleic acid nucleotides include, but are not limited to, the following: U.S. Pat. Nos. 6,268,490; 6,525,191; 6,670,461; 6,770,748; 6,794,499; 6,998,484; 7,053,207; 7,034,133; 7,084,125; 7,399,845; 7,427,672; 7,569,686; 7,741,457; 8,022,193; 8,030,467; 8,278,425; 8,278,426; 8,278,283; US 2008/0039618; and US 2009/0012281, the entire contents of each of which are hereby incorporated herein by reference.

Any of the foregoing bicyclic nucleosides can be prepared having one or more stereochemical sugar configurations including for example α-L-ribofuranose and β-D-ribofuranose (see WO 99/14226).

The RNA of an iRNA can also be modified to include one or more constrained ethyl nucleotides. As used herein, a "constrained ethyl nucleotide" or "cEt" is a locked nucleic acid comprising a bicyclic sugar moiety comprising a 4'-CH (CH3)-O-2' bridge. In one embodiment, a constrained ethyl nucleotide is in the S conformation referred to herein as "5-cEt."

An iRNA of the invention may also include one or more "conformationally restricted nucleotides" ("CRN"). CRN are nucleotide analogs with a linker connecting the C2' and C4' carbons of ribose or the C3 and —C5' carbons of ribose. CRN lock the ribose ring into a stable conformation and increase the hybridization affinity to mRNA. The linker is of sufficient length to place the oxygen in an optimal position for stability and affinity resulting in less ribose ring puckering.

Representative publications that teach the preparation of certain of the above noted CRN include, but are not limited to, US Patent Publication No. 2013/0190383; and PCT publication WO 2013/036868, the entire contents of each of which are hereby incorporated herein by reference.

Potentially stabilizing modifications to the ends of RNA molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-O-deoxythymidine (ether), N-(aminocaproyl)-4-hydroxyprolinol (Hyp-C6-amino), 2-docosanoyl-uridine-3''-phosphate, inverted base dT(idT) and others. Disclosure of this modification can be found in PCT Publication No. WO 2011/005861.

Other modifications of the nucleotides of an iRNA of the invention include a 5' phosphate or 5' phosphate mimic, e.g., a 5'-terminal phosphate or phosphate mimic on the antisense strand of an RNAi agent. Suitable phosphate mimics are disclosed in, for example US Patent Publication No. 2012/0157511, the entire contents of which are incorporated herein by reference.

In certain specific embodiments, the RNAi agent for use in the methods of the invention is an agent selected from the group of agents listed in any one of Tables 3, 4, 6, 7, and 9. These agents may further comprise a ligand.

IV. iRNAs Conjugated to Ligands

Another modification of the RNA of an iRNA of the invention involves chemically linking to the RNA one or more ligands, moieties or conjugates that enhance the activity, cellular distribution or cellular uptake of the iRNA. Such moieties include but are not limited to lipid moieties such as a cholesterol moiety (Letsinger et al., *Proc. Natl. Acid. Sci. USA*, 1989, 86: 6553-6556), cholic acid (Manoharan et al., *Biorg. Med. Chem. Let.*, 1994, 4:1053-1060), a thioether, e.g., beryl-S-tritylthiol (Manoharan et al., *Ann. N.Y. Acad. Sci.*, 1992, 660:306-309; Manoharan et al., *Biorg. Med. Chem. Let.*, 1993, 3:2765-2770), a thiocholesterol (Oberhauser et al., *Nucl. Acids Res.*, 1992, 20:533-538), an aliphatic chain, e.g., dodecandiol or undecyl residues (Saison-Behmoaras et al., *EMBO J*, 1991, 10:1111-1118; Kabanov et al., *FEBS Lett.*, 1990, 259:327-330; Svinarchuk et al., *Biochimie*, 1993, 75:49-54), a phospholipid, e.g., di-hexadecyl-rac-glycerol or triethyl-ammonium 1,2-di-O- hexadecyl-rac-glycero-3-phosphonate (Manoharan et al., *Tetrahedron Lett.*, 1995, 36:3651-3654; Shea et al., *Nucl. Acids Res.*, 1990, 18:3777-3783), a polyamine or a polyethylene glycol chain (Manoharan et al., *Nucleosides & Nucleotides*, 1995, 14:969-973), or adamantane acetic acid (Manoharan et al., *Tetrahedron Lett.*, 1995, 36:3651-3654), a palmityl moiety (Mishra et al., *Biochim. Biophys. Acta*, 1995, 1264:229-237), or an octadecylamine or hexylaminocarbonyloxycholesterol moiety (Crooke et al., *J. Pharmacol. Exp. Ther.*, 1996, 277:923-937).

In one embodiment, a ligand alters the distribution, targeting or lifetime of an iRNA agent into which it is incorporated. In preferred embodiments a ligand provides an enhanced affinity for a selected target, e.g., molecule, cell or cell type, compartment, e.g., a cellular or organ compartment, tissue, organ or region of the body, as, e.g., compared to a species absent such a ligand. Preferred ligands will not take part in duplex pairing in a duplexed nucleic acid.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin, N-acetylgalactosamine, or hyaluronic acid); or a lipid. The ligand can also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly(2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, monovalent or multivalent galactose, N-acetyl-galactosamine, N-acetyl-gulucoseamine multivalent mannose, multivalent fucose, glycosylated polyaminoacids, transferrin, bisphosphonate, polyglutamate, polyaspartate, a lipid, cholesterol, a steroid, bile acid, folate, vitamin B12, vitamin A, biotin, or an RGD peptide or RGD peptide mimetic. In certain embodiments, ligands include monovalent or multivalent galactose. In certain embodiments, ligands include cholesterol.

Other examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g., cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid, O3-(oleoyl) lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]2, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a hepatic cell. Ligands can also include hormones and hormone receptors. They can also include non-peptidic species, such as lipids, lectins, carbohydrates, vitamins, cofactors, multivalent lactose, multivalent galactose, N-acetyl-galactosamine, N-acetyl-gulucosamine multivalent mannose, or multivalent fucose. The ligand can be, for example, a lipopolysaccharide, an activator of p38 MAP kinase, or an activator of NF-κB.

The ligand can be a substance, e.g., a drug, which can increase the uptake of the iRNA agent into the cell, for example, by disrupting the cell's cytoskeleton, e.g., by disrupting the cell's microtubules, microfilaments, and/or intermediate filaments. The drug can be, for example, taxon, vincristine, vinblastine, cytochalasin, nocodazole, japlakinolide, latrunculin A, phalloidin, swinholide A, indanocine, or myoservin.

In some embodiments, a ligand attached to an iRNA as described herein acts as a pharmacokinetic modulator (PK modulator). PK modulators include lipophiles, bile acids, steroids, phospholipid analogues, peptides, protein binding agents, PEG, vitamins etc. Exemplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin etc. Oligonucleotides that comprise a number of phosphorothioate linkages are also known to bind to serum protein, thus short oligonucleotides, e.g., oligonucleotides of about 5 bases, 10 bases, 15 bases or 20 bases, comprising multiple of phosphorothioate linkages in the backbone are also amenable to the present invention as ligands (e.g. as PK modulating ligands). In addition, aptamers that bind serum components (e.g. serum proteins) are also suitable for use as PK modulating ligands in the embodiments described herein.

Ligand-conjugated oligonucleotides of the invention may be synthesized by the use of an oligonucleotide that bears a pendant reactive functionality, such as that derived from the attachment of a linking molecule onto the oligonucleotide (described below). This reactive oligonucleotide may be reacted directly with commercially-available ligands, ligands that are synthesized bearing any of a variety of protecting groups, or ligands that have a linking moiety attached thereto.

The oligonucleotides used in the conjugates of the present invention may be conveniently and routinely made through the well-known technique of solid-phase synthesis. Equipment for such synthesis is sold by several vendors including, for example, Applied Biosystems (Foster City, Calif.). Any other means for such synthesis known in the art may additionally or alternatively be employed. It is also known to use similar techniques to prepare other oligonucleotides, such as the phosphorothioates and alkylated derivatives.

In the ligand-conjugated oligonucleotides and ligand-molecule bearing sequence-specific linked nucleosides of the present invention, the oligonucleotides and oligonucleosides may be assembled on a suitable DNA synthesizer utilizing standard nucleotide or nucleoside precursors, or nucleotide or nucleoside conjugate precursors that already bear the linking moiety, ligand-nucleotide or nucleoside-conjugate precursors that already bear the ligand molecule, or non-nucleoside ligand-bearing building blocks.

When using nucleotide-conjugate precursors that already bear a linking moiety, the synthesis of the sequence-specific linked nucleosides is typically completed, and the ligand molecule is then reacted with the linking moiety to form the ligand-conjugated oligonucleotide. In some embodiments, the oligonucleotides or linked nucleosides of the present invention are synthesized by an automated synthesizer using phosphoramidites derived from ligand-nucleoside conjugates in addition to the standard phosphoramidites and non-standard phosphoramidites that are commercially available and routinely used in oligonucleotide synthesis.

A. Lipid Conjugates

In one embodiment, the ligand or conjugate is a lipid or lipid-based molecule. Such a lipid or lipid-based molecule preferably binds a serum protein, e.g., human serum albumin (HSA). An HSA binding ligand allows for distribution of the conjugate to a target tissue, e.g., a non-kidney target tissue of the body. For example, the target tissue can be the liver, including parenchymal cells of the liver. Other molecules that can bind HSA can also be used as ligands. For example, naproxen or aspirin can be used. A lipid or lipid-based ligand can (a) increase resistance to degradation of the conjugate, (b) increase targeting or transport into a target cell or cell membrane, and/or (c) can be used to adjust binding to a serum protein, e.g., HSA.

A lipid based ligand can be used to inhibit, e.g., control the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In a preferred embodiment, the lipid based ligand binds HSA. Preferably, it binds HSA with a sufficient affinity such that the conjugate will be preferably distributed to a non-kidney tissue. However, it is preferred that the affinity not be so strong that the HSA-ligand binding cannot be reversed.

In another preferred embodiment, the lipid based ligand binds HSA weakly or not at all, such that the conjugate will be preferably distributed to the kidney. Other moieties that target to kidney cells can also be used in place of or in addition to the lipid based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include are B vitamin, e.g., folic acid, B12, riboflavin, biotin, pyridoxal or other vitamins or nutrients taken up by target cells such as liver cells. Also included are HSA and low density lipoprotein (LDL).

B. Cell Permeation Agents

In another aspect, the ligand is a cell-permeation agent, preferably a helical cell-permeation agent. Preferably, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. The helical agent is preferably an alpha-helical agent, which preferably has a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The attachment of peptide and peptidomimetics to iRNA agents can affect pharmacokinetic distribution of the iRNA, such as by enhancing cellular recognition and absorption. The peptide or peptidomimetic moiety can be about 5-50 amino acids long, e.g., about 5, 10, 15, 20, 25, 30, 35, 40, 45, or 50 amino acids long.

A peptide or peptidomimetic can be, for example, a cell permeation peptide, cationic peptide, amphipathic peptide, or hydrophobic peptide (e.g., consisting primarily of Tyr, Trp or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO: 1349). An RFGF analogue (e.g., amino acid sequence AALLPVLLAAP (SEQ ID NO: 1350) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO: 1351) and the Drosophila Antennapedia protein (RQIKIWFQNRRMKWKK (SEQ ID NO: 1352) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., Nature, 354:82-84, 1991). Examples of a peptide or peptidomimetic tethered to a dsRNA agent via an incorporated monomer unit for cell targeting purposes is an arginine-glycine-aspartic acid (RGD)-peptide, or RGD mimic. A peptide moiety can range in length from about 5 amino acids to about 40 amino acids. The peptide moieties can have a structural modification, such as to increase stability or direct conformational properties. Any of the structural modifications described below can be utilized.

An RGD peptide for use in the compositions and methods of the invention may be linear or cyclic, and may be modified, e.g., glycosylated or methylated, to facilitate targeting to a specific tissue(s). RGD-containing peptides and peptidiomimemtics may include D-amino acids, as well as synthetic RGD mimics. In addition to RGD, one can use other moieties that target the integrin ligand. Preferred conjugates of this ligand target PECAM-1 or VEGF.

A "cell permeation peptide" is capable of permeating a cell, e.g., a microbial cell, such as a bacterial or fungal cell, or a mammalian cell, such as a human cell. A microbial cell-permeating peptide can be, for example, a α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003).

C. Carbohydrate Conjugates

In some embodiments of the compositions and methods of the invention, an iRNA oligonucleotide further comprises a carbohydrate. The carbohydrate conjugated iRNA are advantageous for the in vivo delivery of nucleic acids, as well as compositions suitable for in vivo therapeutic use, as described herein. As used herein, "carbohydrate" refers to a compound which is either a carbohydrate per se made up of one or more monosaccharide units having at least 6 carbon atoms (which can be linear, branched or cyclic) with an oxygen, nitrogen or sulfur atom bonded to each carbon atom; or a compound having as a part thereof a carbohydrate moiety made up of one or more monosaccharide units each having at least six carbon atoms (which can be linear, branched or cyclic), with an oxygen, nitrogen or sulfur atom bonded to each carbon atom. Representative carbohydrates include the sugars (mono-, di-, tri- and oligosaccharides containing from about 4, 5, 6, 7, 8, or 9 monosaccharide units), and polysaccharides such as starches, glycogen, cellulose and polysaccharide gums. Specific monosaccharides include C5 and above (e.g., C5, C6, C7, or C8) sugars; di- and trisaccharides include sugars having two or three monosaccharide units (e.g., C5, C6, C7, or C8).

In one embodiment, a carbohydrate conjugate for use in the compositions and methods of the invention is a monosaccharide. In another embodiment, a carbohydrate conjugate for use in the compositions and methods of the invention is selected from the group consisting of:

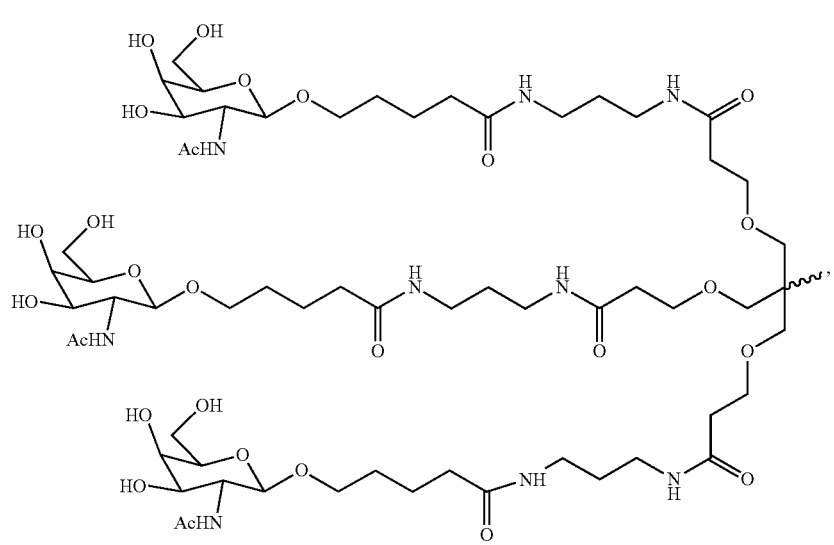

Formula II

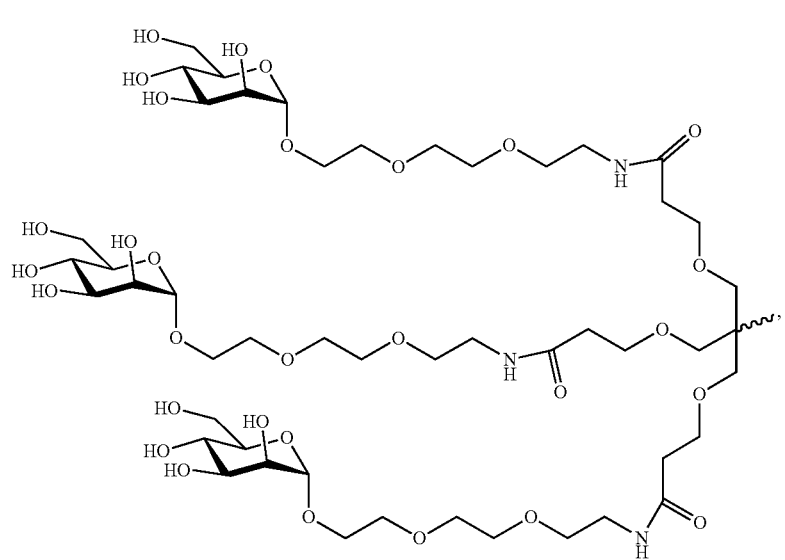

Formula III

Formula IV
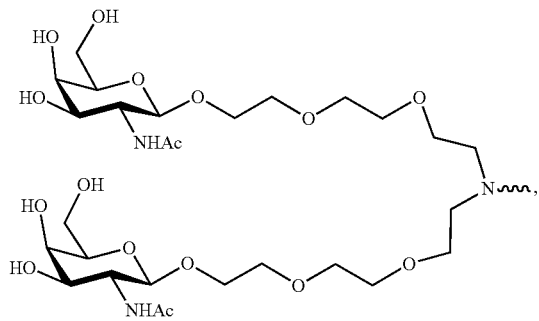
Formula V
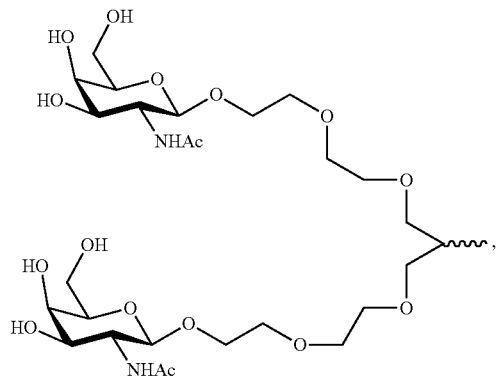
Formula VI
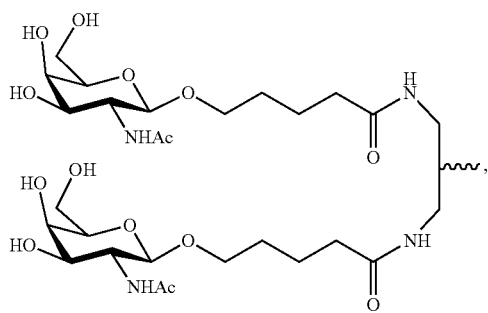
Formula VII
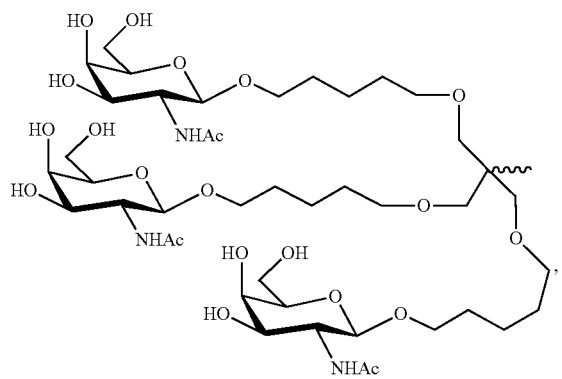
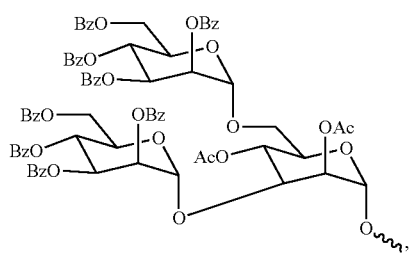
Formula VIII
Formula IX
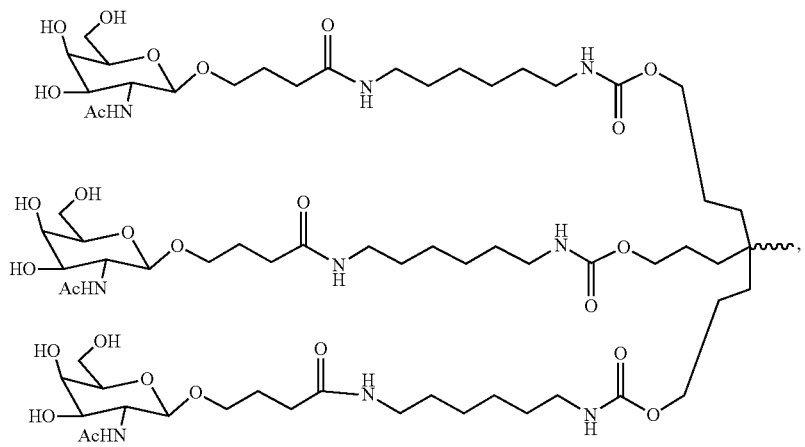

-continued
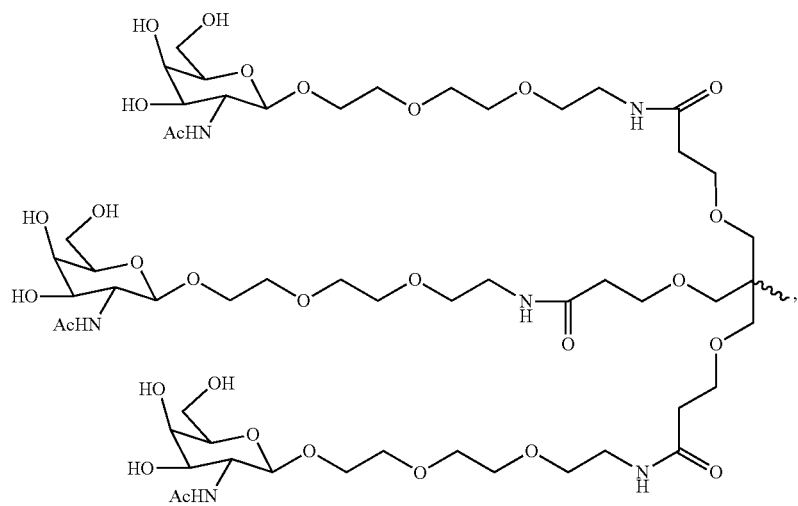
Formula X
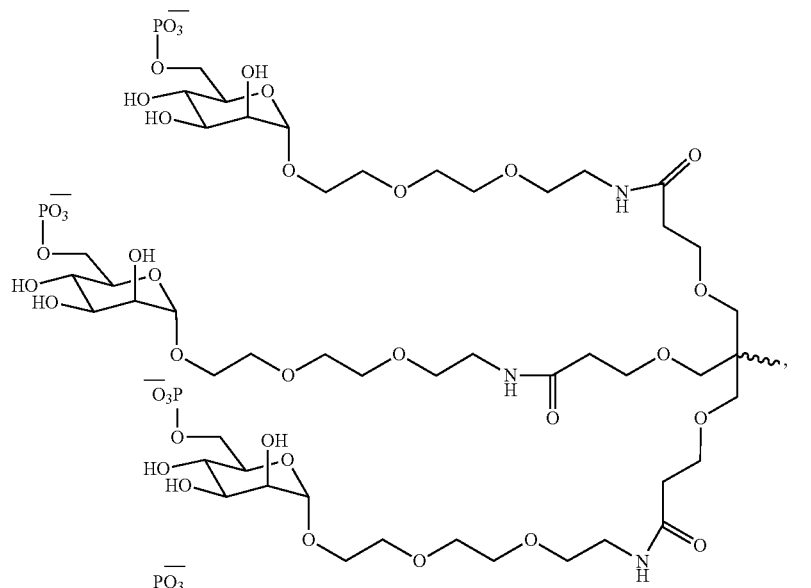
Formula XI
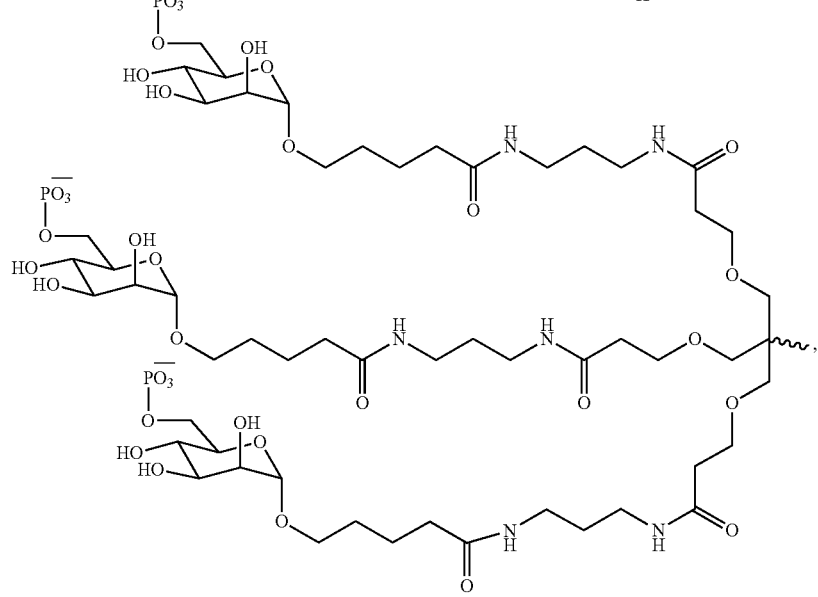
Formula XII

Formula XIII
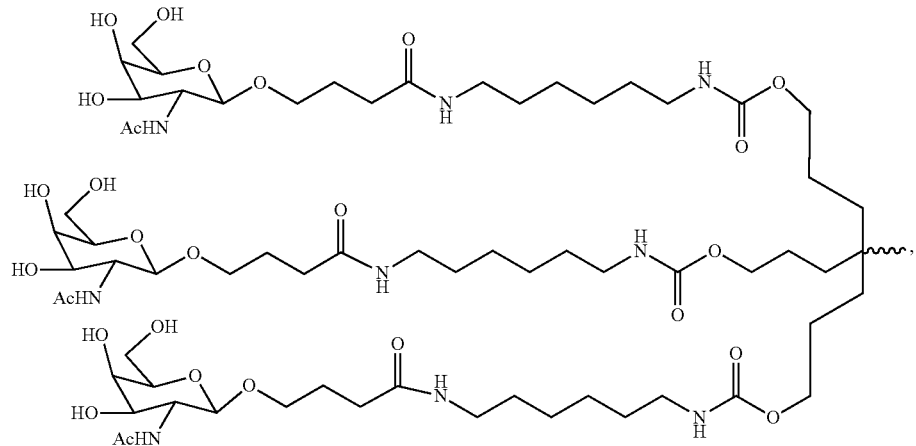
Formula XIV
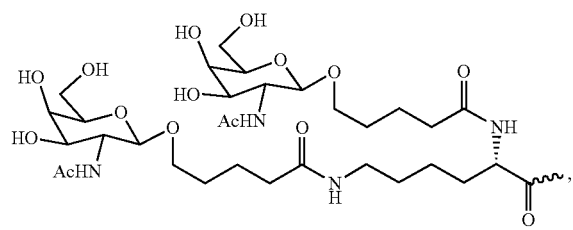
Formula XVI
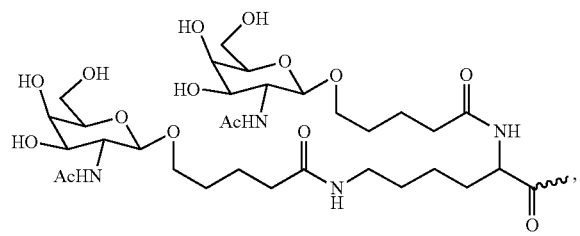
Formula XIX
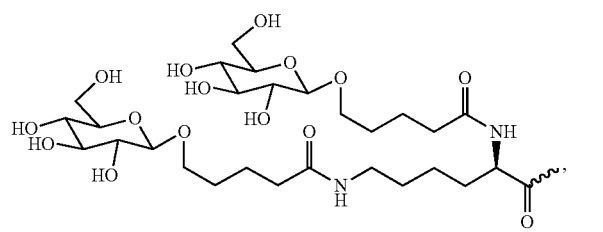
Formula XX
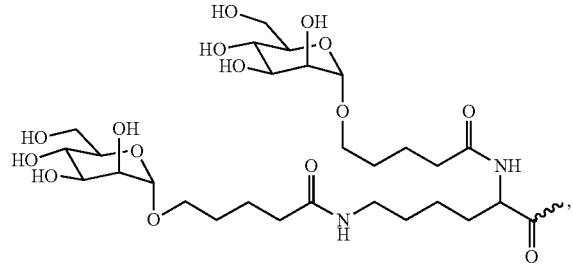
Formula XV
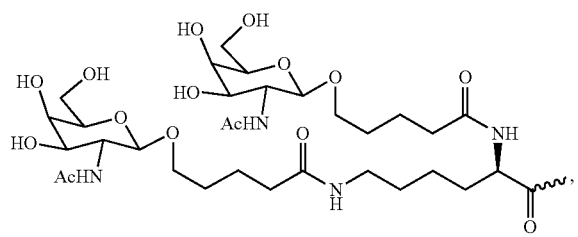
Formula XVII
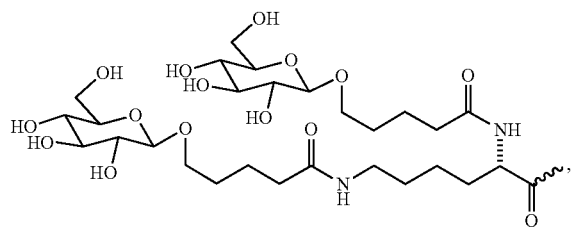
Formula XVIII
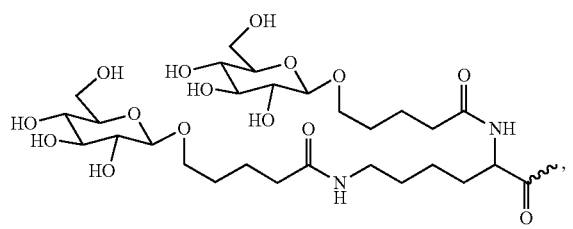
Formula XXI
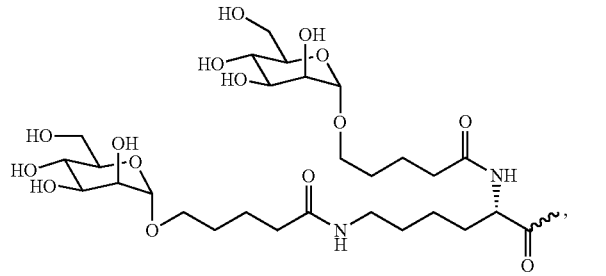

-continued
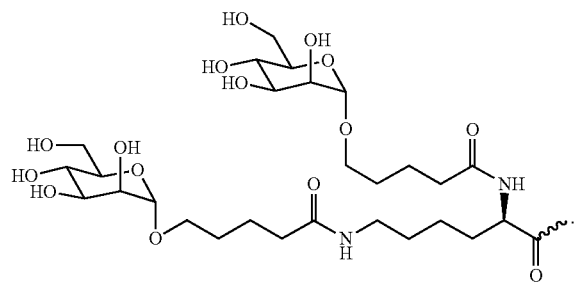
Formula XXII
In one embodiment, the monosaccharide is an N-acetyl-galactosamine, such as
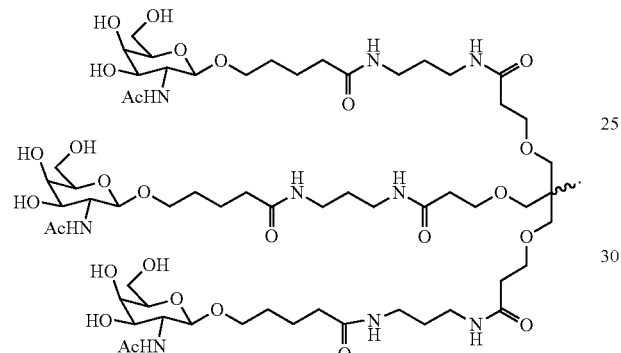
Formula II
Another representative carbohydrate conjugate for use in the embodiments described herein includes, but is not limited to, (Formula XXIII)
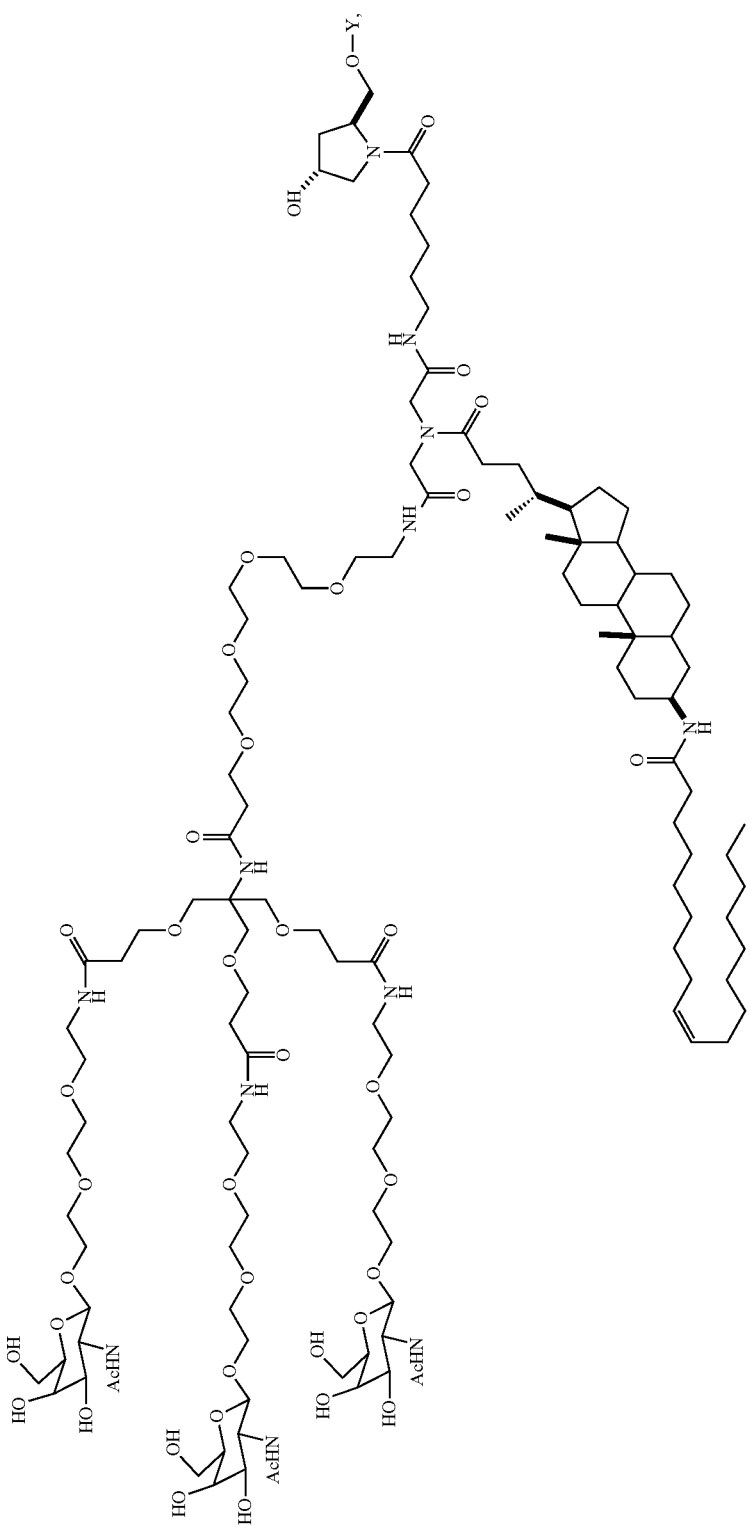

when one of X or Y is an oligonucleotide, the other is a hydrogen.

In certain embodiments of the invention, the GalNAc or GalNAc derivative is attached to an iRNA agent of the invention via a monovalent linker. In some embodiments, the GalNAc or GalNAc derivative is attached to an iRNA agent of the invention via a bivalent linker. In yet other embodiments of the invention, the GalNAc or GalNAc derivative is attached to an iRNA agent of the invention via a trivalent linker.

In one embodiment, the double stranded RNAi agents of the invention comprise one GalNAc or GalNAc derivative attached to the iRNA agent. In another embodiment, the double stranded RNAi agents of the invention comprise a plurality (e.g., 2, 3, 4, 5, or 6) GalNAc or GalNAc derivatives, each independently attached to a plurality of nucleotides of the double stranded RNAi agent through a plurality of monovalent linkers.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker. The hairpin loop may also be formed by an extended overhang in one strand of the duplex.

In some embodiments, the carbohydrate conjugate further comprises one or more additional ligands as described above, such as, but not limited to, a PK modulator and/or a cell permeation peptide.

Additional carbohydrate conjugates suitable for use in the present invention include those described in PCT Publication Nos. WO 2014/179620 and WO 2014/179627, the entire contents of each of which are incorporated herein by reference.

D. Linkers

In some embodiments, the conjugate or ligand described herein can be attached to an iRNA oligonucleotide with various linkers that can be cleavable or non-cleavable.

The term "linker" or "linking group" means an organic moiety that connects two parts of a compound, e.g., covalently attaches two parts of a compound. Linkers typically comprise a direct bond or an atom such as oxygen or sulfur, a unit such as NR8, C(O), C(O)NH, SO, $SO_2$, $SO_2NH$ or a chain of atoms, such as, but not limited to, substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkyl aryl alkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkenyl, alkynylheterocyclylalkynyl, alkylaryl, alkenylaryl, alkynylaryl, alkylheteroaryl, alkenylheteroaryl, alkynylhereroaryl, which one or more methylenes can be interrupted or terminated by O, S, S(O), $SO_2$, N(R8), C(O), substituted or unsubstituted aryl, substituted or unsubstituted heteroaryl, substituted or unsubstituted heterocyclic; where R8 is hydrogen, acyl, aliphatic or substituted aliphatic. In one embodiment, the linker is between about 1-24 atoms, 2-24, 3-24, 4-24, 5-24, 6-24, 6-18, 7-18, 8-18 atoms, 7-17, 8-17, 6-16, 7-16, or 8-16 atoms.

A cleavable linking group is one which is sufficiently stable outside the cell, but which upon entry into a target cell is cleaved to release the two parts the linker is holding together. In a preferred embodiment, the cleavable linking group is cleaved at least about 10 times, 20, times, 30 times, 40 times, 50 times, 60 times, 70 times, 80 times, 90 times or more, or at least about 100 times faster in a target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a preferred pH, thereby releasing a cationic lipid from the ligand inside the cell, or into the desired compartment of the cell.

A linker can include a cleavable linking group that is cleavable by a particular enzyme. The type of cleavable linking group incorporated into a linker can depend on the cell to be targeted. For example, a liver-targeting ligand can be linked to a cationic lipid through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis.

Linkers that contain peptide bonds can be used when targeting cell types rich in peptidases, such as liver cells and synoviocytes.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It can be useful to make initial evaluations in cell-free or culture conditions and to confirm by further evaluations in whole animals. In preferred embodiments, useful candidate compounds are cleaved at least about 2, 4, 10, 20, 30, 40, 50, 60, 70, 80, 90, or about 100 times faster in the cell (or under in vitro conditions selected to mimic intracellular conditions) as compared to blood or serum (or under in vitro conditions selected to mimic extracellular conditions).

i. Redox Cleavable Linking Groups

In one embodiment, a cleavable linking group is a redox cleavable linking group that is cleaved upon reduction or oxidation. An example of reductively cleavable linking group is a disulphide linking group (—S—S—). To determine if a candidate cleavable linking group is a suitable "reductively cleavable linking group," or for example is suitable for use with a particular iRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In one, candidate compounds are cleaved by at most about 10% in the blood. In other embodiments, useful candidate compounds are degraded at least about 2, 4, 10, 20, 30, 40, 50, 60, 70, 80, 90, or about 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

ii. Phosphate-Based Cleavable Linking Groups

In another embodiment, a cleavable linker comprises a phosphate-based cleavable linking group. A phosphate-based cleavable linking group is cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—. Preferred embodiments are —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O—, —S—P(S)(H)—O—, —S—P(O)(H)—S—, —O—P(S)(H)—S—. A preferred embodiment is —O—P(O)(OH)—O—. These candidates can be evaluated using methods analogous to those described above.

iii. Acid Cleavable Linking Groups

In another embodiment, a cleavable linker comprises an acid cleavable linking group. An acid cleavable linking group is a linking group that is cleaved under acidic conditions. In preferred embodiments acid cleavable linking groups are cleaved in an acidic environment with a pH of about 6.5 or lower (e.g., about 6.0, 5.75, 5.5, 5.25, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN—, C(O)O, or —OC(O). A preferred embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

iv. Ester-Based Linking Groups

In another embodiment, a cleavable linker comprises an ester-based cleavable linking group. An ester-based cleavable linking group is cleaved by enzymes such as esterases and amidases in cells. Examples of ester-based cleavable linking groups include but are not limited to esters of alkylene, alkenylene and alkynylene groups. Ester cleavable linking groups have the general formula —C(O)O—, or —OC(O)—. These candidates can be evaluated using methods analogous to those described above.

v. Peptide-Based Cleaving Groups

In yet another embodiment, a cleavable linker comprises a peptide-based cleavable linking group. A peptide-based cleavable linking group is cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynelene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHRAC(O)NHCHRBC(O)—, where RA and RB are the R groups of the two adjacent amino acids. These candidates can be evaluated using methods analogous to those described above.

In one embodiment, an iRNA of the invention is conjugated to a carbohydrate through a linker. Non-limiting examples of iRNA carbohydrate conjugates with linkers of the compositions and methods of the invention include, but are not limited to,

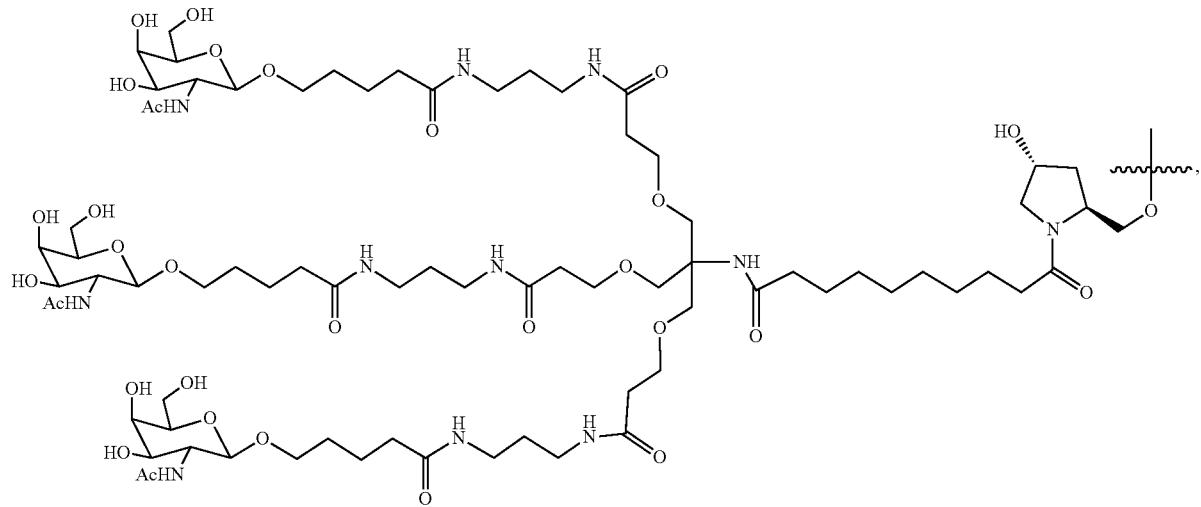
(Formula XXIV)
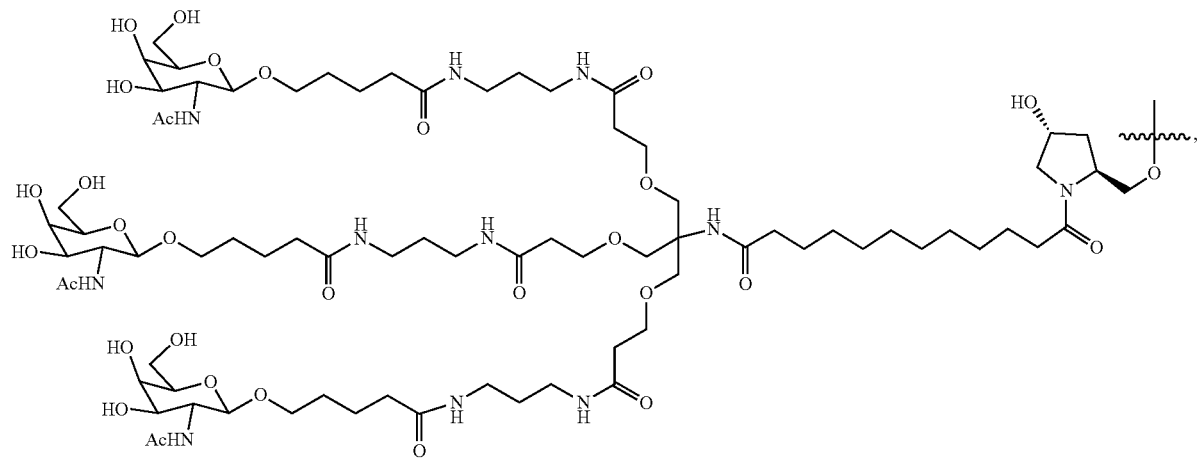
(Formula XXV)
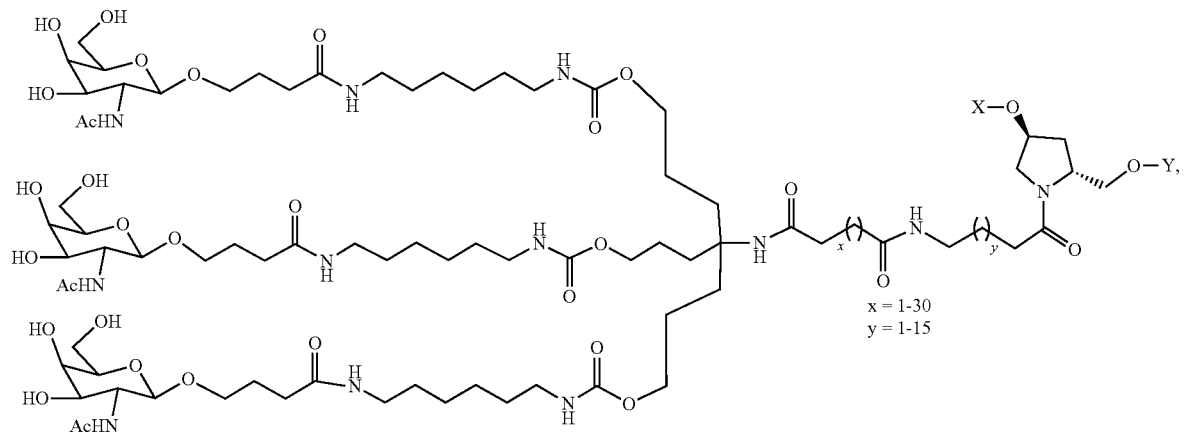
(Formula XXVI)
x = 1-30
y = 1-15

(Formula XXVII)
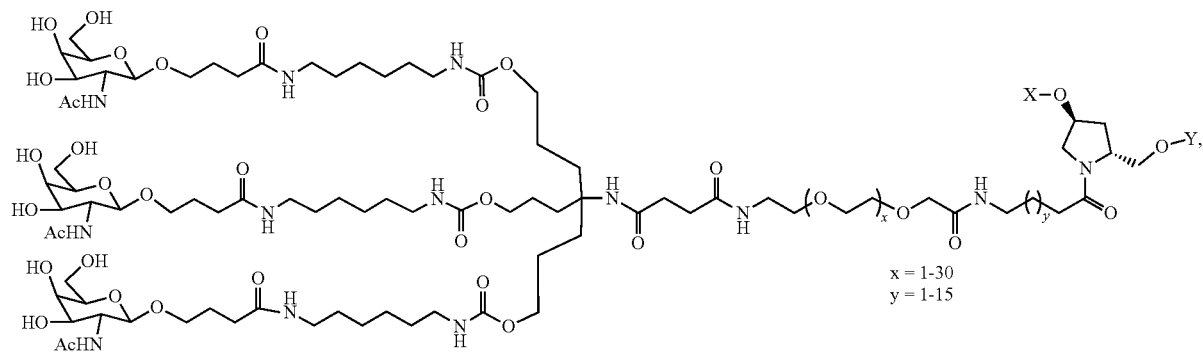
x = 1-30
y = 1-15
(Formula XXVIII)
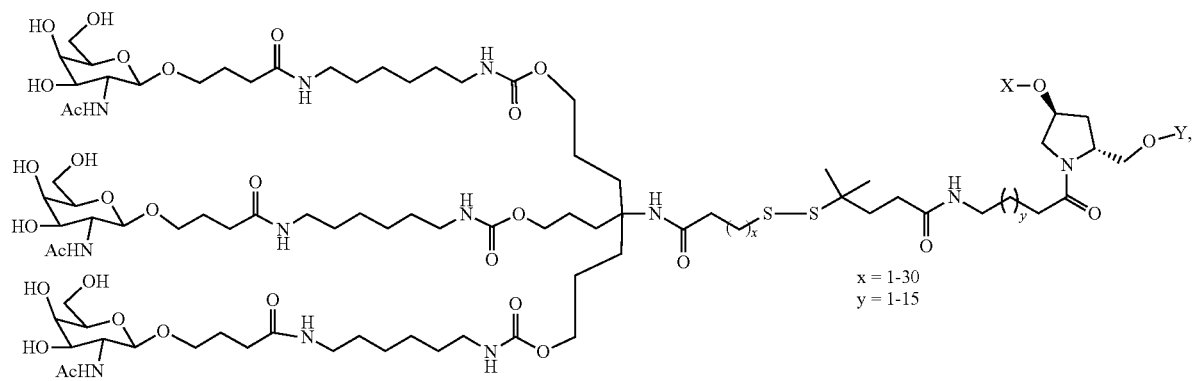
x = 1-30
y = 1-15
(Formula XXIX)
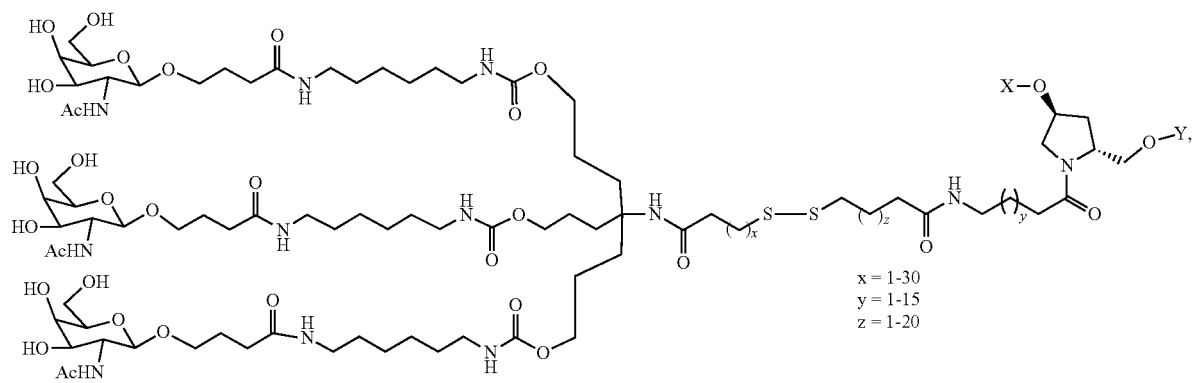
x = 1-30
y = 1-15
z = 1-20
(Formula XXX)
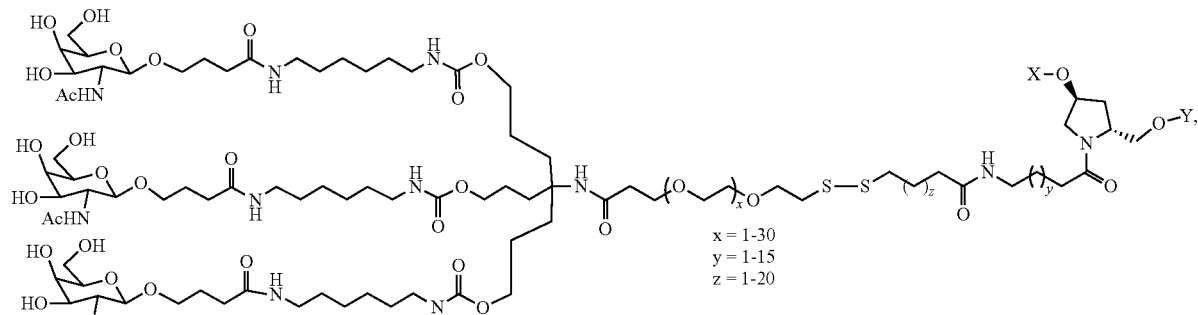
x = 1-30
y = 1-15
z = 1-20
and (Formula XXXI)

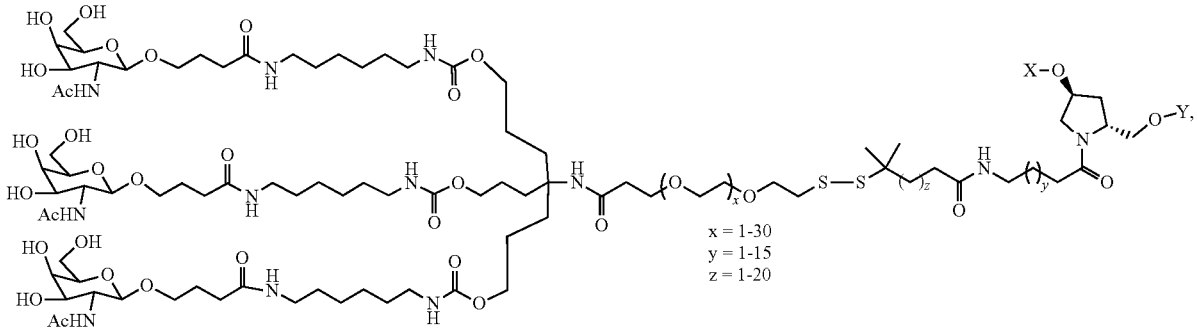

when one of X or Y is an oligonucleotide, the other is a hydrogen.

In certain embodiments of the compositions and methods of the invention, a ligand is one or more "GalNAc" (N-acetylgalactosamine) derivatives attached through a bivalent or trivalent branched linker.

In one embodiment, a dsRNA of the invention is conjugated to a bivalent or trivalent branched linker selected from the group of structures shown in any of formula (XXXII)-(XXXV):

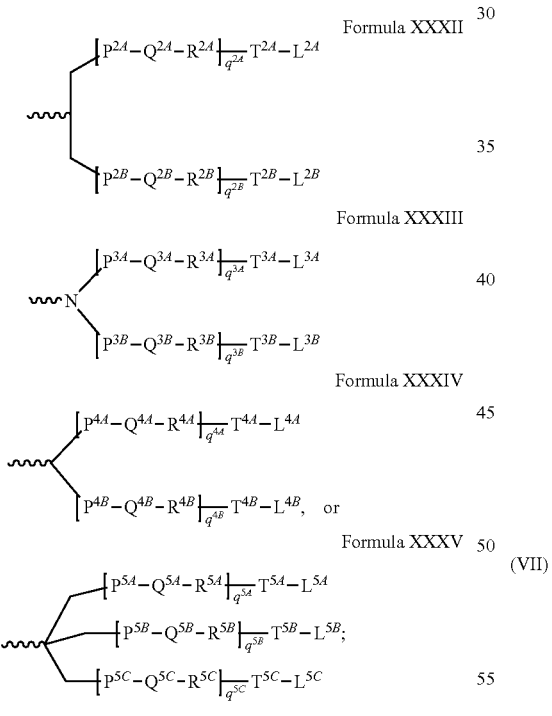

wherein:
q2A, q2B, q3A, q3B, q4A, q4B, q5A, q5B and q5C represent independently for each occurrence 0-20 and wherein the repeating unit can be the same or different;
$P^{2A}$, $P^{2B}$, $P^{3A}$, $P^{3B}$, $P^{4A}$, $P^{4B}$, $P^{5A}$, $P^{5B}$, $P^{5C}$, $T^{2A}$, $T^{2B}$, $T^{3A}$, $T^{3B}$, $T^{4A}$, $T^{4B}$, $T^{4A}$, $T^{5B}$, $T^{5C}$ are each independently for each occurrence absent, CO, NH, O, S, OC(O), NHC(O), $CH_2$, $CH_2NH$ or $CH_2O$;
$Q^{2A}$, $Q^{2B}$, $Q^{3A}$, $Q^{3B}$, $Q^{4A}$, $Q^{4B}$, $Q^{5A}$, $Q^{5B}$, $Q^{5C}$ are independently for each occurrence absent, alkylene, substituted alkylene wherein one or more methylenes can be interrupted or terminated by one or more of O, S, S(O), $SO_2$, $N(R^N)$, C(R')=C(R''), C≡C or C(O);
$R^{2A}$, $R^{2B}$, $R^{3A}$, $R^{3B}$, $R^{4A}$, $R^{4B}$, $R^{5A}$, $R^{5B}$, $R^{5C}$ are each independently for each occurrence absent, NH, O, S, $CH_2$, C(O)O, C(O)NH, $NHCH(R^a)C(O)$, —C(O)—CH$(R^a)$—NH—, CO, CH=N—O,

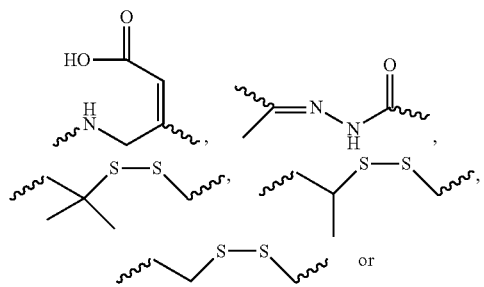

or heterocyclyl;
$L^{2A}$, $L^{2B}$, $L^{3A}$, $L^{3B}$, $L^{4A}$, $L^{4B}$, $L^{5A}$, $L^{5B}$ and $L^{5C}$ represent the ligand; i.e. each independently for each occurrence a monosaccharide (such as GalNAc), disaccharide, trisaccharide, tetrasaccharide, oligosaccharide, or polysaccharide; and $R^a$ is H or amino acid side chain. Trivalent conjugating GalNAc derivatives are particularly useful for use with RNAi agents for inhibiting the expression of a target gene, such as those of formula (XXXV):

(VII)

Formula XXXV

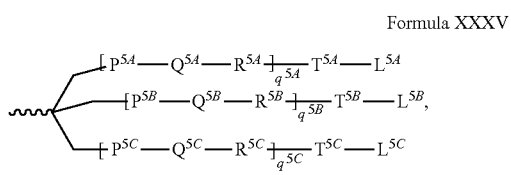

wherein $L^{5A}$, $L^{5B}$ and $L^{5C}$ represent a monosaccharide, such as GalNAc derivative.

Examples of suitable bivalent and trivalent branched linker groups conjugating GalNAc derivatives include, but are not limited to, the structures recited above as formulas II, VII, XI, X, and XIII Representative U.S. patents that teach the preparation of RNA conjugates include, but are not limited to, U.S. Pat.

Nos. 4,828,979; 4,948,882; 5,218,105; 5,525,465; 5,541,313; 5,545,730; 5,552,538; 5,578,717; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391,723; 5,416,203; 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941; 6,294,664; 6,320,017; 6,576,752; 6,783,931; 6,900,297; 7,037,646; 8,106,022, the entire contents of each of which are hereby incorporated herein by reference.

It is not necessary for all positions in a given compound to be uniformly modified, and in fact more than one of the aforementioned modifications can be incorporated in a single compound or even at a single nucleoside within an iRNA. The present invention also includes iRNA compounds that are chimeric compounds.

"Chimeric" iRNA compounds or "chimeras," in the context of this invention, are iRNA compounds, preferably dsRNAs, which contain two or more chemically distinct regions, each made up of at least one monomer unit, i.e., a nucleotide in the case of a dsRNA compound. These iRNAs typically contain at least one region wherein the RNA is modified so as to confer upon the iRNA increased resistance to nuclease degradation, increased cellular uptake, and/or increased binding affinity for the target nucleic acid. An additional region of the iRNA can serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of iRNA inhibition of gene expression. Consequently, comparable results can often be obtained with shorter iRNAs when chimeric dsRNAs are used, compared to phosphorothioate deoxy dsRNAs hybridizing to the same target region. Cleavage of the RNA target can be routinely detected by gel electrophoresis and, if necessary, associated nucleic acid hybridization techniques known in the art.

In certain instances, the RNA of an iRNA can be modified by a non-ligand group. A number of non-ligand molecules have been conjugated to iRNAs in order to enhance the activity, cellular distribution or cellular uptake of the iRNA, and procedures for performing such conjugations are available in the scientific literature. Such non-ligand moieties have included lipid moieties, such as cholesterol (Kubo, T. et al., *Biochem. Biophys. Res. Comm.*, 2007, 365(1):54-61; Letsinger et al., *Proc. Natl. Acad. Sci. USA*, 1989, 86:6553), cholic acid (Manoharan et al., *Bioorg. Med. Chem. Lett.*, 1994, 4:1053), a thioether, e.g., hexyl-S-tritylthiol (Manoharan et al., *Ann. N.Y. Acad. Sci.*, 1992, 660:306; Manoharan et al., *Bioorg. Med. Chem. Let.*, 1993, 3:2765), a thiocholesterol (Oberhauser et al., *Nucl. Acids Res.*, 1992, 20:533), an aliphatic chain, e.g., dodecandiol or undecyl residues (Saison-Behmoaras et al., *EMBO J.*, 1991, 10:111; Kabanov et al., *FEBS Lett.*, 1990, 259:327; Svinarchuk et al., *Biochimie*, 1993, 75:49), a phospholipid, e.g., di-hexadecyl-rac-glycerol or triethylammonium 1,2-di-O-hexadecyl-rac-glycero-3-H-phosphonate (Manoharan et al., *Tetrahedron Lett.*, 1995, 36:3651; Shea et al., *Nucl. Acids Res.*, 1990, 18:3777), a polyamine or a polyethylene glycol chain (Manoharan et al., *Nucleosides & Nucleotides*, 1995, 14:969), or adamantane acetic acid (Manoharan et al., *Tetrahedron Lett.*, 1995, 36:3651), a palmityl moiety (Mishra et al., *Biochim. Biophys. Acta*, 1995, 1264:229), or an octadecylamine or hexylamino-carbonyloxycholesterol moiety (Crooke et al., *J. Pharmacol. Exp. Ther.*, 1996, 277:923). Representative United States patents that teach the preparation of such RNA conjugates have been listed above. Typical conjugation protocols involve the synthesis of an RNAs bearing an aminolinker at one or more positions of the sequence. The amino group is then reacted with the molecule being conjugated using appropriate coupling or activating reagents. The conjugation reaction can be performed either with the RNA still bound to the solid support or following cleavage of the RNA, in solution phase. Purification of the RNA conjugate by HPLC typically affords the pure conjugate.

V. Delivery of an iRNA of the Invention

The delivery of an iRNA of the invention to a cell e.g., a cell within a subject, such as a human subject (e.g., a subject in need thereof, such as a subject having a complement component C3-associated disease as described herein) can be achieved in a number of different ways. For example, delivery may be performed by contacting a cell with an iRNA of the invention either in vitro or in vivo. In vivo delivery may also be performed directly by administering a composition comprising an iRNA, e.g., a dsRNA, to a subject. Alternatively, in vivo delivery may be performed indirectly by administering one or more vectors that encode and direct the expression of the iRNA. These alternatives are discussed further below.

In general, any method of delivering a nucleic acid molecule (in vitro or in vivo) can be adapted for use with an iRNA of the invention (see e.g., Akhtar S. and Julian R L. (1992) *Trends Cell. Biol.* 2(5):139-144 and WO94/02595, which are incorporated herein by reference in their entireties). For in vivo delivery, factors to consider in order to deliver an iRNA molecule include, for example, biological stability of the delivered molecule, prevention of non-specific effects, and accumulation of the delivered molecule in the target tissue. The non-specific effects of an iRNA can be minimized by local administration, for example, by direct injection or implantation into a tissue or topically administering the preparation. Local administration to a treatment site maximizes local concentration of the agent, limits the exposure of the agent to systemic tissues that can otherwise be harmed by the agent or that can degrade the agent, and permits a lower total dose of the iRNA molecule to be administered. Several studies have shown successful knockdown of gene products when an iRNA is administered locally. For example, intraocular delivery of a VEGF dsRNA by intravitreal injection in cynomolgus monkeys (Tolentino, M J., et al (2004) *Retina* 24:132-138) and subretinal injections in mice (Reich, S J., et al (2003) Mol. Vis. 9:210-216) were both shown to prevent neovascularization in an experimental model of age-related macular degeneration. In addition, direct intratumoral injection of a dsRNA in mice reduces tumor volume (Pille, J., et al (2005) *Mol. Ther.* 0.11:267-274) and can prolong survival of tumor-bearing mice (Kim, W J., et al (2006) *Mol. Ther.* 14:343-350; Li, S., et al (2007) *Mol. Ther.* 15:515-523). RNA interference has also shown success with local delivery to the CNS by direct injection (Dorn, G., et al. (2004) *Nucleic Acids* 32:e49; Tan, P H., et al (2005) *Gene Ther.* 12:59-66; Makimura, H., et al (2002) *BMC Neurosci.* 3:18; Shishkina, G T., et al (2004) *Neuroscience* 129:521-528; Thakker, E R., et al (2004) *Proc. Natl. Acad. Sci. U.S.A.* 101:17270-17275;

Akaneya, Y., et al (2005) *J. Neurophysiol*. 93:594-602) and to the lungs by intranasal administration (Howard, K A., et al (2006) *Mol. Ther.* 14:476-484; Zhang, X., et al (2004) *J. Biol. Chem*. 279:10677-10684; Bitko, V., et al (2005) *Nat. Med*. 11:50-55). For administering an iRNA systemically for the treatment of a disease, the RNA can be modified or alternatively delivered using a drug delivery system; both methods act to prevent the rapid degradation of the dsRNA by endo- and exo-nucleases in vivo. Modification of the RNA or the pharmaceutical carrier can also permit targeting of the iRNA composition to the target tissue and avoid undesirable off-target effects. iRNA molecules can be modified by chemical conjugation to lipophilic groups such as cholesterol to enhance cellular uptake and prevent degradation. For example, an iRNA directed against ApoB conjugated to a lipophilic cholesterol moiety was injected systemically into mice and resulted in knockdown of apoB mRNA in both the liver and jejunum (Soutschek, J., et al (2004) *Nature* 432:173-178). Conjugation of an iRNA to an aptamer has been shown to inhibit tumor growth and mediate tumor regression in a mouse model of prostate cancer (McNamara, J O., et al (2006) *Nat. Biotechnol*. 24:1005-1015). In an alternative embodiment, the iRNA can be delivered using drug delivery systems such as a nanoparticle, a dendrimer, a polymer, liposomes, or a cationic delivery system. Positively charged cationic delivery systems facilitate binding of an iRNA molecule (negatively charged) and also enhance interactions at the negatively charged cell membrane to permit efficient uptake of an iRNA by the cell. Cationic lipids, dendrimers, or polymers can either be bound to an iRNA, or induced to form a vesicle or micelle (see e.g., Kim S H., et al (2008) *Journal of Controlled Release* 129(2):107-116) that encases an iRNA. The formation of vesicles or micelles further prevents degradation of the iRNA when administered systemically. Methods for making and administering cationic-iRNA complexes are well within the abilities of one skilled in the art (see e.g., Sorensen, D R., et al (2003) *J. Mol. Biol* 327:761-766; Verma, U N., et al (2003) *Clin. Cancer Res*. 9:1291-1300; Arnold, A S et al (2007) *J. Hypertens*. 25:197-205, which are incorporated herein by reference in their entirety). Some non-limiting examples of drug delivery systems useful for systemic delivery of iRNAs include DOTAP (Sorensen, D R., et al (2003), supra; Verma, U N., et al (2003), supra), Oligofectamine, "solid nucleic acid lipid particles" (Zimmermann, T S., et al (2006) *Nature* 441:111-114), cardiolipin (Chien, P Y., et al (2005) *Cancer Gene Ther.* 12:321-328; Pal, A., et al (2005) *Int J. Oncol*. 26:1087-1091), polyethyleneimine (Bonnet M E., et al (2008) *Pharm. Res*. August 16 Epub ahead of print; Aigner, A. (2006) *J. Biomed. Biotechnol*. 71659), Arg-Gly-Asp (RGD) peptides (Liu, S. (2006) *Mol. Pharm*. 3:472-487), and polyamidoamines (Tomalia, D A., et al (2007) *Biochem. Soc. Trans*. 35:61-67; Yoo, H., et al (1999) *Pharm. Res*. 16:1799-1804). In some embodiments, an iRNA forms a complex with cyclodextrin for systemic administration. Methods for administration and pharmaceutical compositions of iRNAs and cyclodextrins can be found in U.S. Pat. No. 7,427,605, which is herein incorporated by reference in its entirety.

A. Vector encoded iRNAs of the Invention iRNA targeting a C3 gene can be expressed from transcription units inserted into DNA or RNA vectors (see, e.g., Couture, A, et al., TIG. (1996), 12:5-10; Skillern, A., et al., International PCT Publication No. WO 00/22113, Conrad, International PCT Publication No. WO 00/22114, and Conrad, U.S. Pat. No. 6,054,299). Expression can be transient (on the order of hours to weeks) or sustained (weeks to months or longer), depending upon the specific construct used and the target tissue or cell type. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., *Proc. Natl. Acad. Sci. USA* (1995) 92:1292).

The individual strand or strands of an iRNA can be transcribed from a promoter on an expression vector. Where two separate strands are to be expressed to generate, for example, a dsRNA, two separate expression vectors can be co-introduced (e.g., by transfection or infection) into a target cell. Alternatively each individual strand of a dsRNA can be transcribed by promoters both of which are located on the same expression plasmid. In one embodiment, a dsRNA is expressed as inverted repeat polynucleotides joined by a linker polynucleotide sequence such that the dsRNA has a stem and loop structure.

iRNA expression vectors are generally DNA plasmids or viral vectors. Expression vectors compatible with eukaryotic cells, preferably those compatible with vertebrate cells, can be used to produce recombinant constructs for the expression of an iRNA as described herein. Eukaryotic cell expression vectors are well known in the art and are available from a number of commercial sources. Typically, such vectors are provided containing convenient restriction sites for insertion of the desired nucleic acid segment. Delivery of iRNA expressing vectors can be systemic, such as by intravenous or intramuscular administration, by administration to target cells ex-planted from the patient followed by reintroduction into the patient, or by any other means that allows for introduction into a desired target cell.

iRNA expression plasmids can be transfected into target cells as a complex with cationic lipid carriers (e.g., Oligofectamine) or non-cationic lipid-based carriers (e.g., Transit-TKO'). Multiple lipid transfections for iRNA-mediated knockdowns targeting different regions of a target RNA over a period of a week or more are also contemplated by the invention. Successful introduction of vectors into host cells can be monitored using various known methods. For example, transient transfection can be signaled with a reporter, such as a fluorescent marker, such as Green Fluorescent Protein (GFP). Stable transfection of cells ex vivo can be ensured using markers that provide the transfected cell with resistance to specific environmental factors (e.g., antibiotics and drugs), such as hygromycin B resistance.

Viral vector systems which can be utilized with the methods and compositions described herein include, but are not limited to, (a) adenovirus vectors; (b) retrovirus vectors, including but not limited to lentiviral vectors, moloney murine leukemia virus, etc.; (c) adeno-associated virus vectors; (d) herpes simplex virus vectors; (e) SV 40 vectors; (f) polyoma virus vectors; (g) papilloma virus vectors; (h) picornavirus vectors; (i) pox virus vectors such as an orthopox, e.g., vaccinia virus vectors or avipox, e.g. canary pox or fowl pox; and (j) a helper-dependent or gutless adenovirus. Replication-defective viruses can also be advantageous. Different vectors will or will not become incorporated into the cells' genome. The constructs can include viral sequences for transfection, if desired. Alternatively, the construct can be incorporated into vectors capable of episomal replication, e.g. EPV and EBV vectors. Constructs for the recombinant expression of an iRNA will generally require regulatory elements, e.g., promoters, enhancers, etc., to ensure the expression of the iRNA in target cells. Other aspects to consider for vectors and constructs are further described below.

Vectors useful for the delivery of an iRNA will include regulatory elements (promoter, enhancer, etc.) sufficient for expression of the iRNA in the desired target cell or tissue. The regulatory elements can be chosen to provide either constitutive or regulated/inducible expression.

Expression of the iRNA can be precisely regulated, for example, by using an inducible regulatory sequence that is sensitive to certain physiological regulators, e.g., circulating glucose levels, or hormones (Docherty et al., 1994, *FASEB J.* 8:20-24). Such inducible expression systems, suitable for the control of dsRNA expression in cells or in mammals include, for example, regulation by ecdysone, by estrogen, progesterone, tetracycline, chemical inducers of dimerization, and isopropyl-beta-D1-thiogalactopyranoside (IPTG). A person skilled in the art would be able to choose the appropriate regulatory/promoter sequence based on the intended use of the iRNA transgene.

Viral vectors that contain nucleic acid sequences encoding an iRNA can be used. For example, a retroviral vector can be used (see Miller et al., Meth. Enzymol. 217:581-599 (1993)). These retroviral vectors contain the components necessary for the correct packaging of the viral genome and integration into the host cell DNA. The nucleic acid sequences encoding an iRNA are cloned into one or more vectors, which facilitate delivery of the nucleic acid into a patient. More detail about retroviral vectors can be found, for example, in Boesen et al., *Biotherapy* 6:291-302 (1994), which describes the use of a retroviral vector to deliver the mdr1 gene to hematopoietic stem cells in order to make the stem cells more resistant to chemotherapy. Other references illustrating the use of retroviral vectors in gene therapy are: Clowes et al., *J. Clin. Invest.* 93:644-651 (1994); Kiem et al., *Blood* 83:1467-1473 (1994); Salmons and Gunzberg, *Human Gene Therapy* 4:129-141 (1993); and Grossman and Wilson, *Curr. Opin. in Genetics and Devel.* 3:110-114 (1993). Lentiviral vectors contemplated for use include, for example, the HIV based vectors described in U.S. Pat. Nos. 6,143,520; 5,665,557; and 5,981,276, which are herein incorporated by reference.

Adenoviruses are also contemplated for use in delivery of iRNAs of the invention. Adenoviruses are especially attractive vehicles, e.g., for delivering genes to respiratory epithelia. Adenoviruses naturally infect respiratory epithelia where they cause a mild disease. Other targets for adenovirus-based delivery systems are liver, the central nervous system, endothelial cells, and muscle. Adenoviruses have the advantage of being capable of infecting non-dividing cells. Kozarsky and Wilson, *Current Opinion in Genetics and Development* 3:499-503 (1993) present a review of adenovirus-based gene therapy. Bout et al., *Human Gene Therapy* 5:3-10 (1994) demonstrated the use of adenovirus vectors to transfer genes to the respiratory epithelia of rhesus monkeys. Other instances of the use of adenoviruses in gene therapy can be found in Rosenfeld et al., *Science* 252:431-434 (1991); Rosenfeld et al., *Cell* 68:143-155 (1992); Mastrangeli et al., *J. Clin. Invest.* 91:225-234 (1993); PCT Publication WO94/12649; and Wang, et al., *Gene Therapy* 2:775-783 (1995). A suitable AV vector for expressing an iRNA featured in the invention, a method for constructing the recombinant AV vector, and a method for delivering the vector into target cells, are described in Xia H et al. (2002), *Nat. Biotech.* 20: 1006-1010.

Adeno-associated virus (AAV) vectors may also be used to delivery an iRNA of the invention (Walsh et al., *Proc. Soc. Exp. Biol. Med.* 204:289-300 (1993); U.S. Pat. No. 5,436,146). In one embodiment, the iRNA can be expressed as two separate, complementary single-stranded RNA molecules from a recombinant AAV vector having, for example, either the U6 or H1 RNA promoters, or the cytomegalovirus (CMV) promoter. Suitable AAV vectors for expressing the dsRNA featured in the invention, methods for constructing the recombinant AV vector, and methods for delivering the vectors into target cells are described in Samulski R et al. (1987), *J Virol.* 61: 3096-3101; Fisher K J et al. (1996), *J. Virol,* 70: 520-532; Samulski R et al. (1989), *J. Virol.* 63: 3822-3826; U.S. Pat. Nos. 5,252,479; 5,139,941; International Patent Application No. WO 94/13788; and International Patent Application No. WO 93/24641, the entire disclosures of which are herein incorporated by reference.

Another viral vector suitable for delivery of an iRNA of the invention is a pox virus such as a vaccinia virus, for example an attenuated vaccinia such as Modified Virus Ankara (MVA) or NYVAC, an avipox such as fowl pox or canary pox.

The tropism of viral vectors can be modified by pseudotyping the vectors with envelope proteins or other surface antigens from other viruses, or by substituting different viral capsid proteins, as appropriate. For example, lentiviral vectors can be pseudotyped with surface proteins from vesicular stomatitis virus (VSV), rabies, Ebola, Mokola, and the like. AAV vectors can be made to target different cells by engineering the vectors to express different capsid protein serotypes; see, e.g., Rabinowitz J E et al. (2002), J Viral 76:791-801, the entire disclosure of which is herein incorporated by reference.

The pharmaceutical preparation of a vector can include the vector in an acceptable diluent, or can include a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

VI. Pharmaceutical Compositions of the Invention

The present invention also includes pharmaceutical compositions and formulations which include the iRNAs of the invention. In one embodiment, provided herein are pharmaceutical compositions containing an iRNA, as described herein, and a pharmaceutically acceptable carrier. The pharmaceutical compositions containing the iRNA are useful for treating a disease or disorder associated with the expression or activity of a C3 gene, e.g. a complement component C3-associated disease as described herein. Such pharmaceutical compositions are formulated based on the mode of delivery. One example is compositions that are formulated for systemic administration via parenteral delivery, e.g., by subcutaneous (SC), intramuscular (IM), or intravenous (IV) delivery. Another example is compositions that are formulated for direct delivery into the brain parenchyma, e.g., by infusion into the brain, such as by continuous pump infusion. The pharmaceutical compositions of the invention may be administered in dosages sufficient to inhibit expression of the target gene.

The pharmaceutical compositions of the present invention can be administered in a number of ways depending upon whether local or systemic treatment is desired and upon the area to be treated. Administration can be topical (e.g., by a transdermal patch), pulmonary, e.g., by inhalation or insufflation of powders or aerosols, including by nebulizer; intratracheal, intranasal, epidermal and transdermal, oral or parenteral. Parenteral administration includes intravenous, intraarterial, subcutaneous, intraperitoneal or intramuscular injection or infusion; subdermal, e.g., via an implanted device; or intracranial, e.g., by intraparenchymal, intrathecal or intraventricular, administration.

The iRNA can be delivered in a manner to target a particular tissue, such as the liver (e.g., the hepatocytes of the liver).

In some embodiments, the pharmaceutical compositions of the invention are suitable for intramuscular administration to a subject. In other embodiments, the pharmaceutical compositions of the invention are suitable for intravenous administration to a subject. In some embodiments of the invention, the pharmaceutical compositions of the invention are suitable for subcutaneous administration to a subject, e.g., using a 29 g or 30 g needle.

The pharmaceutical compositions of the invention may include an RNAi agent of the invention in an unbuffered solution, such as saline or water, or in a buffer solution, such as a buffer solution comprising acetate, citrate, prolamine, carbonate, or phosphate or any combination thereof.

In one embodiment, the pharmaceutical compositions of the invention, e.g., such as the compositions suitable for subcutaneous administration, comprise an RNAi agent of the invention in phosphate buffered saline (PBS). Suitable concentrations of PBS include, for example, 1 mM, 1.5 mM, 2 mM, 2.5 mM, 3 mM, 3.5 mM, 4 mM, 4.5 mM, 5 mM, 6.5 mM, 7 mM, 7.5 mM, 9 mM, 8.5 mM, 9 mM, 9.5 mM, or about 10 mM PBS. In one embodiment of the invention, a pharmaceutical composition of the invention comprises an RNAi agent of the invention dissolved in a solution of about 5 mM PBS (e.g., 0.64 mM NaH$_2$PO$_4$, 4.36 mM Na$_2$HPO$_4$, 85 mM NaCl). Values intermediate to the above recited ranges and values are also intended to be part of this invention. In addition, ranges of values using a combination of any of the above recited values as upper and/or lower limits are intended to be included.

The pH of the pharmaceutical compositions of the invention may be between about 5.0 to about 8.0, about 5.5 to about 8.0, about 6.0 to about 8.0, about 6.5 to about 8.0, about 7.0 to about 8.0, about 5.0 to about 7.5, about 5.5 to about 7.5, about 6.0 to about 7.5, about 6.5 to about 7.5, about 5.0 to about 7.2, about 5.25 to about 7.2, about 5.5 to about 7.2, about 5.75 to about 7.2, about 6.0 to about 7.2, about 6.5 to about 7.2, or about 6.8 to about 7.2. Ranges and values intermediate to the above recited ranges and values are also intended to be part of this invention.

The osmolality of the pharmaceutical compositions of the invention may be suitable for subcutaneous administration, such as no more than about 400 mOsm/kg, e.g., between 50 and 400 mOsm/kg, between 75 and 400 mOsm/kg, between 100 and 400 mOsm/kg, between 125 and 400 mOsm/kg, between 150 and 400 mOsm/kg, between 175 and 400 mOsm/kg, between 200 and 400 mOsm/kg, between 250 and 400 mOsm/kg, between 300 and 400 mOsm/kg, between 50 and 375 mOsm/kg, between 75 and 375 mOsm/kg, between 100 and 375 mOsm/kg, between 125 and 375 mOsm/kg, between 150 and 375 mOsm/kg, between 175 and 375 mOsm/kg, between 200 and 375 mOsm/kg, between 250 and 375 mOsm/kg, between 300 and 375 mOsm/kg, between 50 and 350 mOsm/kg, between 75 and 350 mOsm/kg, between 100 and 350 mOsm/kg, between 125 and 350 mOsm/kg, between 150 and 350 mOsm/kg, between 175 and 350 mOsm/kg, between 200 and 350 mOsm/kg, between 250 and 350 mOsm/kg, between 50 and 325 mOsm/kg, between 75 and 325 mOsm/kg, between 100 and 325 mOsm/kg, between 125 and 325 mOsm/kg, between 150 and 325 mOsm/kg, between 175 and 325 mOsm/kg, between 200 and 325 mOsm/kg, between 250 and 325 mOsm/kg, between 300 and 325 mOsm/kg, between 300 and 350 mOsm/kg, between 50 and 300 mOsm/kg, between 75 and 300 mOsm/kg, between 100 and 300 mOsm/kg, between 125 and 300 mOsm/kg, between 150 and 300 mOsm/kg, between 175 and 300 mOsm/kg, between 200 and 300 mOsm/kg, between 250 and 300, between 50 and 250 mOsm/kg, between 75 and 250 mOsm/kg, between 100 and 250 mOsm/kg, between 125 and 250 mOsm/kg, between 150 and 250 mOsm/kg, between 175 and 350 mOsm/kg, between 200 and 250 mOsm/kg, e.g., about 50, 55, 60, 65, 70, 75, 80, 85, 90, 95, 100, 105, 110, 120, 125, 130, 135, 140, 145, 150, 155, 160, 165, 170, 175, 180, 185, 190, 195, 200, 205, 210, 215, 220, 225, 230, 235, 240, 245, 250, 255, 260, 265, 270, 275, 280, 285, 295, 300, 305, 310, 320, 325, 330, 335, 340, 345, 350, 355, 360, 365, 370, 375, 380, 385, 390, 395, or about 400 mOsm/kg. Ranges and values intermediate to the above recited ranges and values are also intended to be part of this invention.

The pharmaceutical compositions of the invention comprising the RNAi agents of the invention, may be present in a vial that contains about 0.5, 0.6, 0.7, 0.8, 0.9, 1.0, 1.1, 1.2, 1.3, 1.4, 1.5, 1.6, 1.7, 1.8, 1.9, or about 2.0 mL of the pharmaceutical composition. The concentration of the RNAi agents in the pharmaceutical compositions of the invention may be about 10, 15, 20, 25, 30, 35, 40, 45, 50, 55, 60, 65, 70, 75, 80, 85, 90, 95, 100, 105, 110, 115, 130, 125, 130, 135, 140, 145, 150, 175, 180, 185, 190, 195, 200, 205, 210, 215, 230, 225, 230, 235, 240, 245, 250, 275, 280, 285, 290, 295, 300, 305, 310, 315, 330, 325, 330, 335, 340, 345, 350, 375, 380, 385, 390, 395, 400, 405, 410, 415, 430, 425, 430, 435, 440, 445, 450, 475, 480, 485, 490, 495, or about 500 mg/mL. In one embodiment, the concentration of the RNAi agents in the pharmaceutical compositions of the invention is about 100 mg/mL. Values intermediate to the above recited ranges and values are also intended to be part of this invention.

The pharmaceutical compositions of the invention may comprise a dsRNA agent of the invention in a free acid form. In other embodiments of the invention, the pharmaceutical compositions of the invention may comprise a dsRNA agent of the invention in a salt form, such as a sodium salt form. In certain embodiments, when the dsRNA agents of the invention are in the sodium salt form, sodium ions are present in the agent as counterions for substantially all of the phosphodiester and/or phosphorothioate groups present in the agent. Agents in which substantially all of the phosphodiester and/or phosphorothioate linkages have a sodium counterion include not more than 5, 4, 3, 2, or 1 phosphodiester and/or phosphorothioate linkages without a sodium counterion. In some embodiments, when the dsRNA agents of the invention are in the sodium salt form, sodium ions are present in the agent as counterions for all of the phosphodiester and/or phosphorothioate groups present in the agent.

Pharmaceutical compositions and formulations for topical administration can include transdermal patches, ointments, lotions, creams, gels, drops, suppositories, sprays, liquids and powders. Conventional pharmaceutical carriers, aqueous, powder, or oily bases, thickeners and the like can be necessary or desirable. Coated condoms, gloves and the like can also be useful. Suitable topical formulations include those in which the iRNAs featured in the invention are in admixture with a topical delivery agent such as lipids, liposomes, fatty acids, fatty acid esters, steroids, chelating agents and surfactants. Suitable lipids and liposomes include neutral (e.g., dioleoylphosphatidyl DOPE ethanolamine, dimyristoylphosphatidyl choline DMPC, distearoylphosphatidyl choline) negative (e.g., dimyristoylphosphatidyl glycerol DMPG), and cationic (e.g., dioleoyltetramethylaminopropyl DOTAP and dioleoylphosphatidyl ethanolamine DOTMA). iRNAs featured in the invention can be encapsulated within liposomes or can form complexes thereto, in particular to cationic liposomes. Alternatively, iRNAs can be complexed to lipids, in particular to cationic lipids. Suitable fatty acids and esters include but are not limited to arachidonic acid, oleic acid, eicosanoic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a C1-20 alkyl ester (e.g., isopropylmyristate IPM), monoglyceride or diglyceride or pharmaceutically acceptable salt thereof. Topical formulations are described in detail in U.S. Pat. No. 6,747,014, which is incorporated herein by reference.

A. iRNA Formulations Comprising Membranous Molecular Assemblies

An iRNA for use in the compositions and methods of the invention can be formulated for delivery in a membranous molecular assembly, e.g., a liposome or a micelle. As used herein, the term "liposome" refers to a vesicle composed of amphiphilic lipids arranged in at least one bilayer, e.g., one bilayer or a plurality of bilayers. Liposomes include unilamellar and multilamellar vesicles that have a membrane formed from a lipophilic material and an aqueous interior. The aqueous portion contains the iRNA composition. The lipophilic material isolates the aqueous interior from an aqueous exterior, which typically does not include the iRNA composition, although in some examples, it may. Liposomes are useful for the transfer and delivery of active ingredients to the site of action. Because the liposomal membrane is structurally similar to biological membranes, when liposomes are applied to a tissue, the liposomal bilayer fuses with bilayer of the cellular membranes. As the merging of the liposome and cell progresses, the internal aqueous contents that include the iRNA are delivered into the cell where the iRNA can specifically bind to a target RNA and can mediate RNAi. In some cases the liposomes are also specifically targeted, e.g., to direct the iRNA to particular cell types.

A liposome containing an RNAi agent can be prepared by a variety of methods. In one example, the lipid component of a liposome is dissolved in a detergent so that micelles are formed with the lipid component. For example, the lipid component can be an amphipathic cationic lipid or lipid conjugate. The detergent can have a high critical micelle concentration and may be nonionic. Exemplary detergents include cholate, CHAPS, octylglucoside, deoxycholate, and lauroyl sarcosine. The RNAi agent preparation is then added to the micelles that include the lipid component. The cationic groups on the lipid interact with the RNAi agent and condense around the RNAi agent to form a liposome. After condensation, the detergent is removed, e.g., by dialysis, to yield a liposomal preparation of RNAi agent.

If necessary a carrier compound that assists in condensation can be added during the condensation reaction, e.g., by controlled addition. For example, the carrier compound can be a polymer other than a nucleic acid (e.g., spermine or spermidine). pH can also adjusted to favor condensation.

Methods for producing stable polynucleotide delivery vehicles, which incorporate a polynucleotide/cationic lipid complex as structural components of the delivery vehicle, are further described in, e.g., WO 96/37194, the entire contents of which are incorporated herein by reference. Liposome formation can also include one or more aspects of exemplary methods described in Felgner, P. L. et al., *Proc. Natl. Acad. Sci., USA* 8:7413-7417, 1987; U.S. Pat. Nos. 4,897,355; 5,171,678; Bangham, et al. *M. Mol. Biol.* 23:238, 1965; Olson, et al. *Biochim. Biophys. Acta* 557:9, 1979; Szoka, et al. *Proc. Natl. Acad. Sci.* 75: 4194, 1978; Mayhew, et al. *Biochim. Biophys. Acta* 775:169, 1984; Kim, et al. *Biochim. Biophys. Acta* 728:339, 1983; and Fukunaga, et al. *Endocrinol.* 115:757, 1984. Commonly used techniques for preparing lipid aggregates of appropriate size for use as delivery vehicles include sonication and freeze-thaw plus extrusion (see, e.g., Mayer, et al. *Biochim. Biophys. Acta* 858:161, 1986). Microfluidization can be used when consistently small (50 to 200 nm) and relatively uniform aggregates are desired (Mayhew, et al. *Biochim. Biophys. Acta* 775:169, 1984). These methods are readily adapted to packaging RNAi agent preparations into liposomes.

Liposomes fall into two broad classes. Cationic liposomes are positively charged liposomes which interact with the negatively charged nucleic acid molecules to form a stable complex. The positively charged nucleic acid/liposome complex binds to the negatively charged cell surface and is internalized in an endosome. Due to the acidic pH within the endosome, the liposomes are ruptured, releasing their contents into the cell cytoplasm (Wang et al., *Biochem. Biophys. Res. Commun.*, 1987, 147, 980-985).

Liposomes which are pH-sensitive or negatively-charged, entrap nucleic acids rather than complex with it. Since both the nucleic acid and the lipid are similarly charged, repulsion rather than complex formation occurs. Nevertheless, some nucleic acid is entrapped within the aqueous interior of these liposomes. pH-sensitive liposomes have been used to deliver nucleic acids encoding the thymidine kinase gene to cell monolayers in culture. Expression of the exogenous gene was detected in the target cells (Zhou et al., *Journal of Controlled Release*, 1992, 19, 269-274).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid and/or phosphatidylcholine and/or cholesterol.

Examples of other methods to introduce liposomes into cells in vitro and in vivo include U.S. Pat. Nos. 5,283,185; 5,171,678; WO 94/00569; WO 93/24640; WO 91/16024; Felgner, *J. Biol. Chem.* 269:2550, 1994; Nabel, *Proc. Natl. Acad. Sci.* 90:11307, 1993; Nabel, *Human Gene Ther.* 3:649, 1992; Gershon, *Biochem.* 32:7143, 1993; and Strauss *EMBO J.* 11:417, 1992.

Non-ionic liposomal systems have also been examined to determine their utility in the delivery of drugs to the skin, in particular systems comprising non-ionic surfactant and cholesterol. Non-ionic liposomal formulations comprising Novasome™ I (glyceryl dilaurate/cholesterol/polyoxyethylene-10-stearyl ether) and Novasome™ II (glyceryl distearate/cholesterol/polyoxyethylene-10-stearyl ether) were used to deliver cyclosporin-A into the dermis of mouse skin. Results indicated that such non-ionic liposomal systems were effective in facilitating the deposition of cyclosporine A into different layers of the skin (Hu et al. *S.T.P.Pharma. Sci.*, 1994, 4(6) 466).

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside $G_{M1}$, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., FEBS Letters, 1987, 223, 42; Wu et al., Cancer Research, 1993, 53, 3765).

Various liposomes comprising one or more glycolipids are known in the art. Papahadjopoulos et al. (Ann. N.Y. Acad. Sci., 1987, 507, 64) reported the ability of monosialoganglioside $G_{M1}$, galactocerebroside sulfate and phosphatidylinositol to improve blood half-lives of liposomes. These findings were expounded upon by Gabizon et al. (Proc. Natl. Acad. Sci. U.S.A., 1988, 85, 6949). U.S. Pat. No. 4,837,028 and WO 88/04924, both to Allen et al., disclose liposomes comprising (1) sphingomyelin and (2) the ganglioside $G_{M1}$ or a galactocerebroside sulfate ester. U.S. Pat. No. 5,543,152 (Webb et al.) discloses liposomes comprising sphingomyelin. Liposomes comprising 1,2-sn-dimyristoylphosphatidylcholine are disclosed in WO 97/13499 (Lim et al).

In one embodiment, cationic liposomes are used. Cationic liposomes possess the advantage of being able to fuse to the cell membrane. Non-cationic liposomes, although not able to fuse as efficiently with the plasma membrane, are taken up by macrophages in vivo and can be used to deliver RNAi agents to macrophages.

Further advantages of liposomes include: liposomes obtained from natural phospholipids are biocompatible and biodegradable; liposomes can incorporate a wide range of water and lipid soluble drugs; liposomes can protect encapsulated RNAi agents in their internal compartments from metabolism and degradation (Rosoff, in "Pharmaceutical Dosage Forms," Lieberman, Rieger and Banker (Eds.), 1988, volume 1, p. 245). Important considerations in the preparation of liposome formulations are the lipid surface charge, vesicle size and the aqueous volume of the liposomes.

A positively charged synthetic cationic lipid, N-[1-(2,3-dioleyloxy)propyl]-N,N,N-trimethylammonium chloride (DOTMA) can be used to form small liposomes that interact spontaneously with nucleic acid to form lipid-nucleic acid complexes which are capable of fusing with the negatively charged lipids of the cell membranes of tissue culture cells, resulting in delivery of RNAi agent (see, e.g., Felgner, P. L. et al., Proc. Natl. Acad. Sci., USA 8:7413-7417, 1987 and U.S. Pat. No. 4,897,355 for a description of DOTMA and its use with DNA).

A DOTMA analogue, 1,2-bis(oleoyloxy)-3-(trimethylammonia)propane (DOTAP) can be used in combination with a phospholipid to form DNA-complexing vesicles. Lipofectin™ Bethesda Research Laboratories, Gaithersburg, Md.) is an effective agent for the delivery of highly anionic nucleic acids into living tissue culture cells that comprise positively charged DOTMA liposomes which interact spontaneously with negatively charged polynucleotides to form complexes. When enough positively charged liposomes are used, the net charge on the resulting complexes is also positive. Positively charged complexes prepared in this way spontaneously attach to negatively charged cell surfaces, fuse with the plasma membrane, and efficiently deliver functional nucleic acids into, for example, tissue culture cells. Another commercially available cationic lipid, 1,2-bis(oleoyloxy)-3,3-(trimethylammonia)propane ("DOTAP") (Boehringer Mannheim, Indianapolis, Ind.) differs from DOTMA in that the oleoyl moieties are linked by ester, rather than ether linkages.

Other reported cationic lipid compounds include those that have been conjugated to a variety of moieties including, for example, carboxyspermine which has been conjugated to one of two types of lipids and includes compounds such as 5-carboxyspermylglycine dioctaoleoylamide ("DOGS") (Transfectam™, Promega, Madison, Wis.) and dipalmitoylphosphatidylethanolamine 5-carboxyspermyl-amide ("DPPES") (see, e.g., U.S. Pat. No. 5,171,678).

Another cationic lipid conjugate includes derivatization of the lipid with cholesterol ("DC-Chol") which has been formulated into liposomes in combination with DOPE (See, Gao, X. and Huang, L., Biochim. Biophys. Res. Commun. 179:280, 1991). Lipopolylysine, made by conjugating polylysine to DOPE, has been reported to be effective for transfection in the presence of serum (Zhou, X. et al., Biochim. Biophys. Acta 1065:8, 1991). For certain cell lines, these liposomes containing conjugated cationic lipids, are said to exhibit lower toxicity and provide more efficient transfection than the DOTMA-containing compositions. Other commercially available cationic lipid products include DMRIE and DMRIE-HP (Vical, La Jolla, Calif.) and Lipofectamine (DOSPA) (Life Technology, Inc., Gaithersburg, Md.). Other cationic lipids suitable for the delivery of oligonucleotides are described in WO 98/39359 and WO 96/37194.

Liposomal formulations are particularly suited for topical administration, liposomes present several advantages over other formulations. Such advantages include reduced side effects related to high systemic absorption of the administered drug, increased accumulation of the administered drug at the desired target, and the ability to administer RNAi agent into the skin. In some implementations, liposomes are used for delivering RNAi agent to epidermal cells and also to enhance the penetration of RNAi agent into dermal tissues, e.g., into skin. For example, the liposomes can be applied topically. Topical delivery of drugs formulated as liposomes to the skin has been documented (see, e.g., Weiner et al., Journal of Drug Targeting, 1992, vol. 2, 405-410 and du Plessis et al., Antiviral Research, 18, 1992, 259-265; Mannino, R. J. and Fould-Fogerite, S., Biotechniques 6:682-690, 1988; Itani, T. et al. Gene 56:267-276. 1987; Nicolau, C. et al. Meth. Enz. 149:157-176, 1987; Straubinger, R. M. and Papahadjopoulos, D. Meth. Enz. 101:512-527, 1983; Wang, C. Y. and Huang, L., Proc. Natl. Acad. Sci. USA 84:7851-7855, 1987).

Non-ionic liposomal systems have also been examined to determine their utility in the delivery of drugs to the skin, in particular systems comprising non-ionic surfactant and cholesterol. Non-ionic liposomal formulations comprising Novasome I (glyceryl dilaurate/cholesterol/polyoxyethylene-10-stearyl ether) and Novasome II (glyceryl distearate/cholesterol/polyoxyethylene-10-stearyl ether) were used to deliver a drug into the dermis of mouse skin. Such formulations with RNAi agent are useful for treating a dermatological disorder.

Liposomes that include iRNA can be made highly deformable. Such deformability can enable the liposomes to penetrate through pore that are smaller than the average radius of the liposome. For example, transfersomes are a type of deformable liposomes. Transferosomes can be made by adding surface edge activators, usually surfactants, to a standard liposomal composition. Transfersomes that include RNAi agent can be delivered, for example, subcutaneously by infection in order to deliver RNAi agent to keratinocytes in the skin. In order to cross intact mammalian skin, lipid vesicles must pass through a series of fine pores, each with a diameter less than 50 nm, under the influence of a suitable transdermal gradient. In addition, due to the lipid properties, these transferosomes can be self-optimizing (adaptive to the shape of pores, e.g., in the skin), self-repairing, and can frequently reach their targets without fragmenting, and often self-loading.

Other formulations amenable to the present invention are described in PCT Publication No. WO 2008/042973.

Transfersomes are yet another type of liposomes, and are highly deformable lipid aggregates which are attractive candidates for drug delivery vehicles. Transfersomes can be described as lipid droplets which are so highly deformable that they are easily able to penetrate through pores which are smaller than the droplet. Transfersomes are adaptable to the environment in which they are used, e.g., they are self-optimizing (adaptive to the shape of pores in the skin), self-repairing, frequently reach their targets without fragmenting, and often self-loading. To make transfersomes it is possible to add surface edge-activators, usually surfactants, to a standard liposomal composition. Transfersomes have been used to deliver serum albumin to the skin. The transfersome-mediated delivery of serum albumin has been shown to be as effective as subcutaneous injection of a solution containing serum albumin.

Surfactants find wide application in formulations such as emulsions (including microemulsions) and liposomes. The most common way of classifying and ranking the properties of the many different types of surfactants, both natural and synthetic, is by the use of the hydrophile/lipophile balance (HLB). The nature of the hydrophilic group (also known as the "head") provides the most useful means for categorizing the different surfactants used in formulations (Rieger, in "Pharmaceutical Dosage Forms", Marcel Dekker, Inc., New York, N.Y., 1988, p. 285).

If the surfactant molecule is not ionized, it is classified as a nonionic surfactant. Nonionic surfactants find wide application in pharmaceutical and cosmetic products and are usable over a wide range of pH values. In general their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

The use of surfactants in drug products, formulations and in emulsions has been reviewed (Rieger, in "Pharmaceutical Dosage Forms", Marcel Dekker, Inc., New York, N.Y., 1988, p. 285).

The iRNA for use in the methods of the invention can also be provided as micellar formulations. "Micelles" are defined herein as a particular type of molecular assembly in which amphipathic molecules are arranged in a spherical structure such that all the hydrophobic portions of the molecules are directed inward, leaving the hydrophilic portions in contact with the surrounding aqueous phase. The converse arrangement exists if the environment is hydrophobic.

A mixed micellar formulation suitable for delivery through transdermal membranes may be prepared by mixing an aqueous solution of the siRNA composition, an alkali metal $C_8$ to $C_{22}$ alkyl sulphate, and a micelle forming compounds. Exemplary micelle forming compounds include lecithin, hyaluronic acid, pharmaceutically acceptable salts of hyaluronic acid, glycolic acid, lactic acid, chamomile extract, cucumber extract, oleic acid, linoleic acid, linolenic acid, monoolein, monooleates, monolaurates, borage oil, evening of primrose oil, menthol, trihydroxy oxo cholanyl glycine and pharmaceutically acceptable salts thereof, glycerin, polyglycerin, lysine, polylysine, triolein, polyoxyethylene ethers and analogues thereof, polidocanol alkyl ethers and analogues thereof, chenodeoxycholate, deoxycholate, and mixtures thereof. The micelle forming compounds may be added at the same time or after addition of the alkali metal alkyl sulphate. Mixed micelles will form with substantially any kind of mixing of the ingredients but vigorous mixing in order to provide smaller size micelles.

In one method a first micellar composition is prepared which contains the siRNA composition and at least the alkali metal alkyl sulphate. The first micellar composition is then mixed with at least three micelle forming compounds to form a mixed micellar composition. In another method, the micellar composition is prepared by mixing the siRNA composition, the alkali metal alkyl sulphate and at least one of the micelle forming compounds, followed by addition of the remaining micelle forming compounds, with vigorous mixing.

Phenol and/or m-cresol may be added to the mixed micellar composition to stabilize the formulation and protect against bacterial growth. Alternatively, phenol and/or m-cresol may be added with the micelle forming ingredients. An isotonic agent such as glycerin may also be added after formation of the mixed micellar composition.

For delivery of the micellar formulation as a spray, the formulation can be put into an aerosol dispenser and the dispenser is charged with a propellant. The propellant, which is under pressure, is in liquid form in the dispenser. The ratios of the ingredients are adjusted so that the aqueous and propellant phases become one, i.e., there is one phase. If there are two phases, it is necessary to shake the dispenser prior to dispensing a portion of the contents, e.g., through a metered valve. The dispensed dose of pharmaceutical agent is propelled from the metered valve in a fine spray.

Propellants may include hydrogen-containing chlorofluorocarbons, hydrogen-containing fluorocarbons, dimethyl ether and diethyl ether. In certain embodiments, HFA 134a (1,1,1,2 tetrafluoroethane) may be used.

The specific concentrations of the essential ingredients can be determined by relatively straightforward experimentation. For absorption through the oral cavities, it is often desirable to increase, e.g., at least double or triple, the dosage for through injection or administration through the gastrointestinal tract.

B. Lipid Particles iRNAs, e.g., dsRNAs of in the invention may be fully encapsulated in a lipid formulation, e.g., a LNP, or other nucleic acid-lipid particle.

As used herein, the term "LNP" refers to a stable nucleic acid-lipid particle. LNPs typically contain a cationic lipid, a non-cationic lipid, and a lipid that prevents aggregation of the particle (e.g., a PEG-lipid conjugate). LNPs are extremely useful for systemic applications, as they exhibit extended circulation lifetimes following intravenous (i.v.) injection and accumulate at distal sites (e.g., sites physically separated from the administration site). LNPs include "pSPLP," which include an encapsulated condensing agent-nucleic acid complex as set forth in PCT Publication No. WO 00/03683. The particles of the present invention typically have a mean diameter of about 50 nm to about 150 nm, more typically about 60 nm to about 130 nm, more typically about 70 nm to about 110 nm, most typically about 70 nm to about 90 nm, and are substantially nontoxic. In addition, the nucleic acids when present in the nucleic acid-lipid particles of the present invention are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586,410; 6,815,432; U.S. Publication No. 2010/0324120 and PCT Publication No. WO 96/40964.

In one embodiment, the lipid to drug ratio (mass/mass ratio) (e.g., lipid to dsRNA ratio) will be in the range of from about 1:1 to about 50:1, from about 1:1 to about 25:1, from about 3:1 to about 15:1, from about 4:1 to about 10:1, from about 5:1 to about 9:1, or about 6:1 to about 9:1. Ranges intermediate to the above recited ranges are also contemplated to be part of the invention.

The cationic lipid can be, for example, N,N-dioleyl-N,N-dimethylammonium chloride (DODAC), N,N-distearyl-N, N-dimethylammonium bromide (DDAB), N-(I-(2,3-dioleoyloxy)propyl)-N,N,N-trimethylammonium chloride (DOTAP), N-(I-(2,3-dioleyloxy)propyl)-N,N,N-trimethylammonium chloride (DOTMA), N,N-dimethyl-2,3-dioleyloxy)propylamine (DODMA), 1,2-DiLinoleyloxy-N,N-dimethylaminopropane (DLinDMA), 1,2-Dilinolenyloxy-N,N-dimethylaminopropane (DLenDMA), 1,2-Dilinoleylcarbamoyloxy-3-dimethylaminopropane (DLin-C-DAP), 1,2-Dilinoleyoxy-3-(dimethylamino) acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA·Cl), 1,2-Dilinoleoyl-3-trimethylaminopropane chloride salt (DLin-TAP·Cl), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DMA), 1,2-Dilinolenyloxy-N,N-dimethylaminopropane (DLinDMA), 2,2-Dilinoleyl-4-dimethylaminomethyl-[1,3]-dioxolane (DLin-K-DMA) or analogs thereof, (3aR,5s,6aS)—N,N-dimethyl-2,2-di((9Z,12Z)-octadeca-9,12-dienyl)tetrahydro-3aH-cyclopenta[d][1,3]dioxol-5-amine (ALN100), (6Z,9Z,28Z,31Z)-heptatriaconta-6,9,28,31-tetraen-19-yl 4-(dimethylamino)butanoate (MC3), 1,1'-(2-(4-(2-((2-(bis (2-hydroxydodecyl)amino)ethyl)(2-hydroxydodecyl)amino) ethyl)piperazin-1-yl)ethylazanediyl)didodecan-2-ol (Tech G1), or a mixture thereof. The cationic lipid can comprise from about 20 mol % to about 50 mol % or about 40 mol % of the total lipid present in the particle.

In another embodiment, the compound 2,2-Dilinoleyl-4-dimethylaminoethyl-[1,3]-dioxolane can be used to prepare lipid-siRNA nanoparticles. Synthesis of 2,2-Dilinoleyl-4-dimethylaminoethyl-[1,3]-dioxolane is described in U.S. provisional patent application No. 61/107,998 filed on Oct. 23, 2008, which is herein incorporated by reference.

In one embodiment, the lipid-siRNA particle includes 40% 2,2-Dilinoleyl-4-dimethylaminoethyl-[1,3]-dioxolane: 10% DSPC: 40% Cholesterol: 10% PEG-C-DOMG (mole percent) with a particle size of 63.0±20 nm and a 0.027 siRNA/Lipid Ratio.

The ionizable/non-cationic lipid can be an anionic lipid or a neutral lipid including, but not limited to, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoylphosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), distearoyl-phosphatidyl-ethanolamine (DSPE), 16-O-monomethyl PE, 16-O-dimethyl PE, 18-1-trans PE, 1-stearoyl-2-oleoyl-phosphatidyethanolamine (SOPE), cholesterol, or a mixture thereof. The non-cationic lipid can be from about 5 mol % to about 90 mol %, about 10 mol %, or about 58 mol % if cholesterol is included, of the total lipid present in the particle.

The conjugated lipid that inhibits aggregation of particles can be, for example, a polyethyleneglycol (PEG)-lipid including, without limitation, a PEG-diacylglycerol (DAG), a PEG-dialkyloxypropyl (DAA), a PEG-phospholipid, a PEG-ceramide (Cer), or a mixture thereof. The PEG-DAA conjugate can be, for example, a PEG-dilauryloxypropyl ($Ci_2$), a PEG-dimyristyloxypropyl ($Ci_4$), a PEG-dipalmityloxypropyl ($Ci_6$), or a PEG-distearyloxypropyl ($C]_8$). The conjugated lipid that prevents aggregation of particles can be from 0 mol % to about 20 mol % or about 2 mol % of the total lipid present in the particle.

In some embodiments, the nucleic acid-lipid particle further includes cholesterol at, e.g., about 10 mol % to about 60 mol % or about 48 mol % of the total lipid present in the particle.

In one embodiment, the lipidoid ND98.4HCl (MW 1487) (see U.S. patent application Ser. No. 12/056,230, filed Mar. 26, 2008, which is incorporated herein by reference), Cholesterol (Sigma-Aldrich), and PEG-Ceramide C16 (Avanti Polar Lipids) can be used to prepare lipid-dsRNA nanoparticles (i.e., LNP01 particles). Stock solutions of each in ethanol can be prepared as follows: ND98, 133 mg/ml; Cholesterol, 25 mg/ml, PEG-Ceramide C16, 100 mg/ml. The ND98, Cholesterol, and PEG-Ceramide C16 stock solutions can then be combined in a, e.g., 42:48:10 molar ratio. The combined lipid solution can be mixed with aqueous dsRNA (e.g., in sodium acetate pH 5) such that the final ethanol concentration is about 35-45% and the final sodium acetate concentration is about 100-300 mM. Lipid-dsRNA nanoparticles typically form spontaneously upon mixing. Depending on the desired particle size distribution, the resultant nanoparticle mixture can be extruded through a polycarbonate membrane (e.g., 100 nm cut-off) using, for example, a thermobarrel extruder, such as Lipex Extruder (Northern Lipids, Inc). In some cases, the extrusion step can be omitted. Ethanol removal and simultaneous buffer exchange can be accomplished by, for example, dialysis or tangential flow filtration. Buffer can be exchanged with, for example, phosphate buffered saline (PBS) at about pH 7, e.g., about pH 6.9, about pH 7.0, about pH 7.1, about pH 7.2, about pH 7.3, or about pH 7.4.

ND98 Isomer I

Formula 1

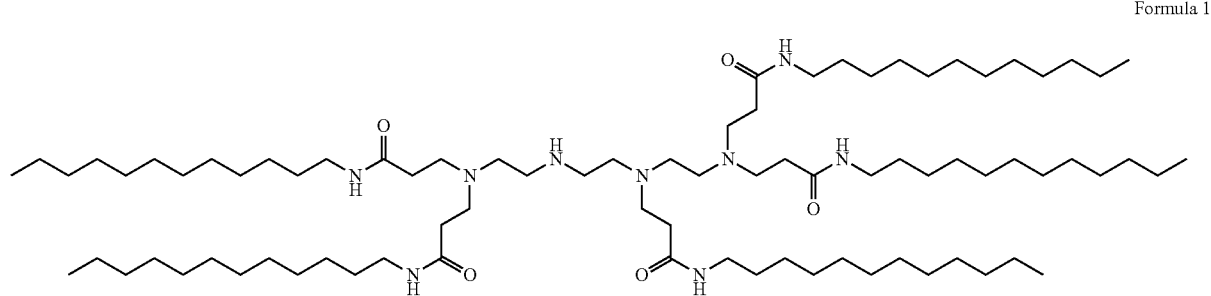

LNP01 formulations are described, e.g., in International Application Publication No. WO 2008/042973, which is hereby incorporated by reference.

Additional exemplary lipid-dsRNA formulations are described in Table 1.

TABLE 1

| | Ionizable/Cationic Lipid | cationic lipid/non-cationic lipid/cholesterol/ PEG-lipid conjugate Lipid:siRNA ratio |
|---|---|---|
| SNALP-1 | 1,2-Dilinolenyloxy-N,N-dimethylaminopropane (DLinDMA) | DLinDMA/DPPC/Cholesterol/PEG-cDMA (57.1/7.1/34.4/1.4) lipid:siRNA~7:1 |
| 2-XTC | 2,2-Dilinoleyl-4-dimethylaminoethyl-[1,3]-dioxolane (XTC) | XTC/DPPC/Cholesterol/PEG-cDMA 57.1/7.1/34.4/1.4 lipid:siRNA~7:1 |
| LNP05 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA~6:1 |
| LNP06 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA~11:1 |
| LNP07 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA~6:1 |
| LNP08 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA~11:1 |
| LNP09 | 2,2-Dilinoleyl-4-dimethylaminoethyl-[1,3]-dioxolane (XTC) | XTC/DSPC/Cholesterol/PEG-DMG 50/10/38.5/1.5 Lipid:siRNA 10:1 |
| LNP10 | (3aR,5s,6aS)-N,N-dimethyl-2,2-di((9Z,12Z)-octadeca-9,12-dienyl)tetrahydro-3aH-cyclopenta[d][1,3]dioxol-5-amine (ALN100) | ALN100/DSPC/Cholesterol/PEG-DMG 50/10/38.5/1.5 Lipid:siRNA 10:1 |
| LNP11 | (6Z,9Z,28Z,31Z)-heptatriaconta-6,9,28,31-tetraen-19-yl 4-(dimethylamino)butanoate (MC3) | MC-3/DSPC/Cholesterol/PEG-DMG 50/10/38.5/1.5 Lipid:siRNA 10:1 |
| LNP12 | 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (Tech G1) | Tech G1/DSPC/Cholesterol/PEG-DMG 50/10/38.5/1.5 Lipid:siRNA 10:1 |
| LNP13 | XTC | XTC/DSPC/Chol/PEG-DMG 50/10/38.5/1.5 Lipid:siRNA: 33:1 |
| LNP14 | MC3 | MC3/DSPC/Chol/PEG-DMG 40/15/40/5 Lipid:siRNA: 11:1 |
| LNP15 | MC3 | MC3/DSPC/Chol/PEG-DSG/GalNAc-PEG-DSG 50/10/35/4.5/0.5 Lipid:siRNA: 11:1 |

TABLE 1-continued

| | Ionizable/Cationic Lipid | cationic lipid/non-cationic lipid/cholesterol/PEG-lipid conjugate<br>Lipid:siRNA ratio |
|---|---|---|
| LNP16 | MC3 | MC3/DSPC/Chol/PEG-DMG<br>50/10/38.5/1.5<br>Lipid:siRNA: 7:1 |
| LNP17 | MC3 | MC3/DSPC/Chol/PEG-DSG<br>50/10/38.5/1.5<br>Lipid:siRNA: 10:1 |
| LNP18 | MC3 | MC3/DSPC/Chol/PEG-DMG<br>50/10/38.5/1.5<br>Lipid:siRNA: 12:1 |
| LNP19 | MC3 | MC3/DSPC/Chol/PEG-DMG<br>50/10/35/5<br>Lipid:siRNA: 8:1 |
| LNP20 | MC3 | MC3/DSPC/Chol/PEG-DPG<br>50/10/38.5/1.5<br>Lipid:siRNA: 10:1 |
| LNP21 | C12-200 | C12-200/DSPC/Chol/PEG-DSG<br>50/10/38.5/1.5<br>Lipid:siRNA: 7:1 |
| LNP22 | XTC | XTC/DSPC/Chol/PEG-DSG<br>50/10/38.5/1.5<br>Lipid:siRNA: 10:1 |

DSPC: distearoylphosphatidylcholine
DPPC: dipalmitoylphosphatidylcholine
PEG-DMG: PEG-didimyristoyl glycerol (C14-PEG, or PEG-C14) (PEG with avg mol wt of 2000)
PEG-DSG: PEG-distyryl glycerol (C18-PEG, or PEG-C18) (PEG with avg mol wt of 2000)
PEG-cDMA: PEG-carbamoyl-1,2-dimyristyloxypropylamine (PEG with avg mol wt of 2000) SNALP (1,2-Dilinolenyloxy-N,N-dimethylaminopropane (DLinDMA)) comprising formulations are described in International Publication No. WO2009/127060, filed Apr. 15, 2009, which is hereby incorporated by reference.

XTC comprising formulations are described in PCT Publication No. WO 2010/088537, the entire contents of which are hereby incorporated herein by reference.

MC3 comprising formulations are described, e.g., in U.S. Publication No. 2010/0324120, filed Jun. 10, 2010, the entire contents of which are hereby incorporated by reference.

ALNY-100 comprising formulations are described in PCT Publication No. WO 2010/054406, the entire contents of which are hereby incorporated herein by reference.

C12-200 comprising formulations are described in PCT Publication No. WO 2010/129709, the entire contents of which are hereby incorporated herein by reference.

Compositions and formulations for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids or binders can be desirable. In some embodiments, oral formulations are those in which dsRNAs featured in the invention are administered in conjunction with one or more penetration enhancer surfactants and chelators. Suitable surfactants include fatty acids and/or esters or salts thereof, bile acids and/or salts thereof. Suitable bile acids/salts include chenodeoxycholic acid (CDCA) and ursodeoxychenodeoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate and sodium glycodihydrofusidate. Suitable fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a monoglyceride, a diglyceride or a pharmaceutically acceptable salt thereof (e.g., sodium). In some embodiments, combinations of penetration enhancers are used, for example, fatty acids/salts in combination with bile acids/salts. One exemplary combination is the sodium salt of lauric acid, capric acid and UDCA. Further penetration enhancers include polyoxyethylene-9-lauryl ether, polyoxyethylene-20-cetyl ether. DsRNAs featured in the invention can be delivered orally, in granular form including sprayed dried particles, or complexed to form micro or nanoparticles. DsRNA complexing agents include poly-amino acids; polyimines; polyacrylates; polyalkylacrylates, polyoxethanes, polyalkylcyanoacrylates; cationized gelatins, albumins, starches, acrylates, polyethyleneglycols (PEG) and starches; polyalkylcyanoacrylates; DEAE-derivatized polyimines, pollulans, celluloses and starches. Suitable complexing agents include chitosan, N-trimethylchitosan, poly-L-lysine, polyhistidine, polyornithine, polyspermines, protamine, polyvinylpyridine, polythiodiethylaminomethylethylene P(TDAE), polyaminostyrene (e.g., p-amino), poly(methylcyanoacrylate), poly(ethylcyanoacrylate), poly(butylcyanoacrylate), poly(isobutylcyanoacrylate), poly(isohexylcynaoacrylate), DEAE-methacrylate, DEAE-hexylacrylate, DEAE-acrylamide, DEAE-albumin and DEAE-dextran, polymethylacrylate, polyhexylacrylate, poly(D,L-lactic acid), poly(DL-lactic-co-glycolic acid (PLGA), alginate, and polyethyleneglycol (PEG). Oral formulations for dsRNAs and their preparation are described in detail in U.S. Pat. No. 6,887,906, US Publn. No. 20030027780, and U.S. Pat. No. 6,747,014, each of which is incorporated herein by reference.

Compositions and formulations for parenteral, intraparenchymal (into the brain), intrathecal, intraventricular or intrahepatic administration can include sterile aqueous solutions which can also contain buffers, diluents and other suitable additives such as, but not limited to, penetration enhancers, carrier compounds and other pharmaceutically acceptable carriers or excipients.

Pharmaceutical compositions of the present invention include, but are not limited to, solutions, emulsions, and liposome-containing formulations. These compositions can be generated from a variety of components that include, but are not limited to, preformed liquids, self-emulsifying solids and self-emulsifying semisolids. Particularly preferred are formulations that target the liver when treating hepatic disorders such as hepatic carcinoma.

The pharmaceutical formulations of the present invention, which can conveniently be presented in unit dosage form, can be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers or finely divided solid carriers or both, and then, if necessary, shaping the product.

The compositions of the present invention can be formulated into any of many possible dosage forms such as, but not limited to, tablets, capsules, gel capsules, liquid syrups, soft gels, suppositories, and enemas. The compositions of the present invention can also be formulated as suspensions in aqueous, non-aqueous or mixed media. Aqueous suspensions can further contain substances which increase the viscosity of the suspension including, for example, sodium carboxymethylcellulose, sorbitol and/or dextran. The suspension can also contain stabilizers.

C. Additional Formulations i. Emulsions

The compositions of the present invention can be prepared and formulated as emulsions. Emulsions are typically heterogeneous systems of one liquid dispersed in another in the form of droplets usually exceeding 0.1 μm in diameter (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions can be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions can contain additional components in addition to the dispersed phases, and the active drug which can be present as a solution in either the aqueous phase, oily phase or itself as a separate phase. Pharmaceutical excipients such as emulsifiers, stabilizers, dyes, and antioxidants can also be present in emulsions as needed. Pharmaceutical emulsions can also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Either of the phases of the emulsion can be a semisolid or a solid, as is the case of emulsion-style ointment bases and creams. Other means of stabilizing emulsions entail the use of emulsifiers that can be incorporated into either phase of the emulsion. Emulsifiers can broadly be classified into four categories: synthetic surfactants, naturally occurring emulsifiers, absorption bases, and finely dispersed solids (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants can be classified into different classes based on the nature of the hydrophilic group: nonionic, anionic, cationic and amphoteric (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y. Rieger, in Pharmaceutical Dosage Forms, Lieberman, Rieger and Banker (Eds.), 1988, Marcel Dekker, Inc., New York, N.Y., volume 1, p. 285).

Naturally occurring emulsifiers used in emulsion formulations include lanolin, beeswax, phosphatides, lecithin and acacia. Absorption bases possess hydrophilic properties such that they can soak up water to form w/o emulsions yet retain their semisolid consistencies, such as anhydrous lanolin and hydrophilic petrolatum. Finely divided solids have also been used as good emulsifiers especially in combination with surfactants and in viscous preparations. These include polar inorganic solids, such as heavy metal hydroxides, nonswelling clays such as bentonite, attapulgite, hectorite, kaolin, montmorillonite, colloidal aluminum silicate and colloidal magnesium aluminum silicate, pigments and nonpolar solids such as carbon or glyceryl tristearate.

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

Hydrophilic colloids or hydrocolloids include naturally occurring gums and synthetic polymers such as polysaccharides (for example, acacia, agar, alginic acid, carrageenan, guar gum, karaya gum, and tragacanth), cellulose derivatives (for example, carboxymethylcellulose and carboxypropylcellulose), and synthetic polymers (for example, carbomers, cellulose ethers, and carboxyvinyl polymers). These disperse or swell in water to form colloidal solutions that stabilize emulsions by forming strong interfacial films around the dispersed-phase droplets and by increasing the viscosity of the external phase.

Since emulsions often contain a number of ingredients such as carbohydrates, proteins, sterols and phosphatides that can readily support the growth of microbes, these formulations often incorporate preservatives. Commonly used preservatives included in emulsion formulations include methyl paraben, propyl paraben, quaternary ammonium salts, benzalkonium chloride, esters of p-hydroxybenzoic acid, and boric acid. Antioxidants are also commonly added to emulsion formulations to prevent deterioration of the formulation. Antioxidants used can be free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

The application of emulsion formulations via dermatological, oral and parenteral routes and methods for their manufacture have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199). Emulsion formulations for oral delivery have been very widely used because of ease of formulation, as well as efficacy from an absorption and bioavailability standpoint (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245; Idson, in Pharmaceutical Dosage Forms, Lieberman, Rieger and Banker (Eds.), 1988, Marcel Dekker, Inc., New York, N.Y., volume 1, p. 199). Mineral-oil base laxatives, oil-soluble vitamins and high fat nutritive preparations are among the materials that have commonly been administered orally as o/w emulsions.

ii. Microemulsions

In one embodiment of the present invention, the compositions of iRNAs and nucleic acids are formulated as microemulsions. A microemulsion can be defined as a system of water, oil and amphiphile which is a single optically isotropic and thermodynamically stable liquid solution (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245). Typically microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215). Microemulsions commonly are prepared via a combination of three to five components that include oil, water, surfactant, cosurfactant and electrolyte. Whether the microemulsion is of the water-in-oil (w/o) or an oil-in-water (o/w) type is dependent on the properties of the oil and surfactant used and on the structure and geometric packing of the polar heads and hydrocarbon tails of the surfactant molecules (Schott, in Remington's Pharmaceutical Sciences, Mack Publishing Co., Easton, Pa., 1985, p. 271).

The phenomenological approach utilizing phase diagrams has been extensively studied and has yielded a comprehensive knowledge, to one skilled in the art, of how to formulate microemulsions (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245; Block, in Pharmaceutical Dosage Forms, Lieberman, Rieger and Banker (Eds.), 1988, Marcel Dekker, Inc., New York, N.Y., volume 1, p. 335). Compared to conventional emulsions, microemulsions offer the advantage of solubilizing water-insoluble drugs in a formulation of thermodynamically stable droplets that are formed spontaneously.

Surfactants used in the preparation of microemulsions include, but are not limited to, ionic surfactants, non-ionic surfactants, Brij 96, polyoxyethylene oleyl ethers, polyglycerol fatty acid esters, tetraglycerol monolaurate (ML310), tetraglycerol monooleate (M0310), hexaglycerol monooleate (P0310), hexaglycerol pentaoleate (P0500), decaglycerol monocaprate (MCA750), decaglycerol monooleate (M0750), decaglycerol sequioleate (SO750), decaglycerol decaoleate (DAO750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules. Microemulsions can, however, be prepared without the use of cosurfactants and alcohol-free self-emulsifying microemulsion systems are known in the art. The aqueous phase can typically be, but is not limited to, water, an aqueous solution of the drug, glycerol, PEG300, PEG400, polyglycerols, propylene glycols, and derivatives of ethylene glycol. The oil phase can include, but is not limited to, materials such as Captex 300, Captex 355, Capmul MCM, fatty acid esters, medium chain (C8-C12) mono, di, and tri-glycerides, polyoxyethylated glyceryl fatty acid esters, fatty alcohols, polyglycolized glycerides, saturated polyglycolized C8-C10 glycerides, vegetable oils and silicone oil.

Microemulsions are particularly of interest from the standpoint of drug solubilization and the enhanced absorption of drugs. Lipid based microemulsions (both o/w and w/o) have been proposed to enhance the oral bioavailability of drugs, including peptides (see e.g., U.S. Pat. Nos. 6,191,105; 7,063,860; 7,070,802; 7,157,099; Constantinides et al., Pharmaceutical Research, 1994, 11, 1385-1390; Ritschel, Meth. Find. Exp. Clin. Pharmacol., 1993, 13, 205). Microemulsions afford advantages of improved drug solubilization, protection of drug from enzymatic hydrolysis, possible enhancement of drug absorption due to surfactant-induced alterations in membrane fluidity and permeability, ease of preparation, ease of oral administration over solid dosage forms, improved clinical potency, and decreased toxicity (see e.g., U.S. Pat. Nos. 6,191,105; 7,063,860; 7,070,802; 7,157,099; Constantinides et al., Pharmaceutical Research, 1994, 11, 1385; Ho et al., J. Pharm. Sci., 1996, 85, 138-143). Often microemulsions can form spontaneously when their components are brought together at ambient temperature. This can be particularly advantageous when formulating thermolabile drugs, peptides or iRNAs. Microemulsions have also been effective in the transdermal delivery of active components in both cosmetic and pharmaceutical applications. It is expected that the microemulsion compositions and formulations of the present invention will facilitate the increased systemic absorption of iRNAs and nucleic acids from the gastrointestinal tract, as well as improve the local cellular uptake of iRNAs and nucleic acids.

Microemulsions of the present invention can also contain additional components and additives such as sorbitan monostearate (Grill 3), Labrasol, and penetration enhancers to improve the properties of the formulation and to enhance the absorption of the iRNAs and nucleic acids of the present invention. Penetration enhancers used in the microemulsions of the present invention can be classified as belonging to one of five broad categories—surfactants, fatty acids, bile salts, chelating agents, and non-chelating non-surfactants (Lee et al., Critical Reviews in Therapeutic Drug Carrier Systems, 1991, p. 92). Each of these classes has been discussed above.

iii. Microparticles

An RNAi agent of the invention may be incorporated into a particle, e.g., a microparticle. Microparticles can be produced by spray-drying, but may also be produced by other methods including lyophilization, evaporation, fluid bed drying, vacuum drying, or a combination of these techniques.

iv. Penetration Enhancers

In one embodiment, the present invention employs various penetration enhancers to effect the efficient delivery of nucleic acids, particularly iRNAs, to the skin of animals. Most drugs are present in solution in both ionized and nonionized forms. However, usually only lipid soluble or lipophilic drugs readily cross cell membranes. It has been discovered that even non-lipophilic drugs can cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers can be classified as belonging to one of five broad categories, i.e., surfactants, fatty acids, bile salts, chelating agents, and non-chelating non-surfactants (see e.g., Malmsten, M. Surfactants and polymers in drug delivery, Informa Health Care, New York, N.Y., 2002; Lee et al., Critical Reviews in Therapeutic Drug Carrier Systems, 1991, p. 92). Each of the above mentioned classes of penetration enhancers are described below in greater detail. Such compounds are well known in the art.

v. Carriers

Certain compositions of the present invention also incorporate carrier compounds in the formulation. As used herein, "carrier compound" or "carrier" can refer to a nucleic acid, or analog thereof, which is inert (i.e., does not possess biological activity per se) but is recognized as a nucleic acid by in vivo processes that reduce the bioavailability of a nucleic acid having biological activity by, for example, degrading the biologically active nucleic acid or promoting its removal from circulation. The coadministration of a nucleic acid and a carrier compound, typically with an excess of the latter substance, can result in a substantial reduction of the amount of nucleic acid recovered in the liver, kidney or other extracirculatory reservoirs, presumably due to competition between the carrier compound and the nucleic acid for a common receptor. For example, the recovery of a partially phosphorothioate dsRNA in hepatic tissue can be reduced when it is coadministered with polyinosinic acid, dextran sulfate, polycytidic acid or 4-acetamido-4'isothiocyano-stilbene-2,2'-disulfonic acid (Miyao et al., DsRNA Res. Dev., 1995, 5, 115-121; Takakura et al., DsRNA & Nucl. Acid Drug Dev., 1996, 6, 177-183.

vi. Excipients

In contrast to a carrier compound, a "pharmaceutical carrier" or "excipient" is a pharmaceutically acceptable solvent, suspending agent or any other pharmacologically inert vehicle for delivering one or more nucleic acids to an animal. The excipient can be liquid or solid and is selected, with the planned manner of administration in mind, so as to provide for the desired bulk, consistency, etc., when combined with a nucleic acid and the other components of a given pharmaceutical composition. Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc).

Pharmaceutically acceptable organic or inorganic excipients suitable for non-parenteral administration which do not deleteriously react with nucleic acids can also be used to formulate the compositions of the present invention. Suitable pharmaceutically acceptable carriers include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone and the like.

Formulations for topical administration of nucleic acids can include sterile and non-sterile aqueous solutions, non-aqueous solutions in common solvents such as alcohols, or solutions of the nucleic acids in liquid or solid oil bases. The solutions can also contain buffers, diluents and other suitable additives. Pharmaceutically acceptable organic or inorganic excipients suitable for non-parenteral administration which do not deleteriously react with nucleic acids can be used.

Suitable pharmaceutically acceptable excipients include, but are not limited to, water, salt solutions, alcohol, polyethylene glycols, gelatin, lactose, amylose, magnesium stearate, talc, silicic acid, viscous paraffin, hydroxymethylcellulose, polyvinylpyrrolidone and the like.

vii. Other Components

The compositions of the present invention can additionally contain other adjunct components conventionally found in pharmaceutical compositions, at their art-established usage levels. Thus, for example, the compositions can contain additional, compatible, pharmaceutically-active materials such as, for example, antipruritics, astringents, local anesthetics or anti-inflammatory agents, or can contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings and/or aromatic substances and the like which do not deleteriously interact with the nucleic acid(s) of the formulation.

Aqueous suspensions can contain substances which increase the viscosity of the suspension including, for example, sodium carboxymethylcellulose, sorbitol and/or dextran. The suspension can also contain stabilizers.

In some embodiments, pharmaceutical compositions featured in the invention include (a) one or more iRNA compounds and (b) one or more agents which function by a non-RNAi mechanism and which are useful in treating a complement component C3-associated disease or disorder, e.g., paroxysmal nocturnal hemoglobinuria (PNH), atypical hemolytic uremic syndrome (aHUS), neuromyelitis optica (NMO), multifocal motor neuropathy (MMN), myasthenia gravis (MG), C3 glomerulonephritis, or systemic lupus erythmatosis.

In addition, other substances commonly used to protect the liver, such as silymarin, can also be used in conjunction with the iRNAs described herein. Other agents useful for treating liver diseases include telbivudine, entecavir, and protease inhibitors such as telaprevir and other disclosed, for example, in Tung et al., U.S. Application Publication Nos. 2005/0148548, 2004/0167116, and 2003/0144217; and in Hale et al., U.S. Application Publication No. 2004/0127488.

Toxicity and therapeutic efficacy of such compounds can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds that exhibit high therapeutic indices are preferred.

The data obtained from cell culture assays and animal studies can be used in formulating a range of dosage for use in humans. The dosage of compositions featured herein in the invention lies generally within a range of circulating concentrations that include the ED50 with little or no toxicity. The dosage can vary within this range depending upon the dosage form employed and the route of administration utilized. For any compound used in the methods featured in the invention, the therapeutically effective dose can be estimated initially from cell culture assays. A dose can be formulated in animal models to achieve a circulating plasma concentration range of the compound or, when appropriate, of the polypeptide product of a target sequence (e.g., achieving a decreased concentration of the polypeptide) that includes the $IC_{50}$ (i.e., the concentration of the test compound which achieves a half-maximal inhibition of symptoms) as determined in cell culture. Such information can be used to more accurately determine useful doses in humans. Levels in plasma can be measured, for example, by high performance liquid chromatography.

In addition to their administration, as discussed above, the iRNAs featured in the invention can be administered in combination with other known agents effective in treatment of pathological processes mediated by C3 expression. In any event, the administering physician can adjust the amount and timing of iRNA administration on the basis of results observed using standard measures of efficacy known in the art or described herein.

VII. Methods for Inhibiting Complement Component C3 Expression

The present invention provides methods of inhibiting expression of a complement component C3 gene as described herein. In one aspect, the present invention provides methods of inhibiting expression of C3 in a cell. The methods include contacting a cell with an RNAi agent, e.g., a double stranded RNAi agent, in an amount effective to inhibit expression of the C3 in the cell, thereby inhibiting expression of the C3 in the cell.

Contacting of a cell with an RNAi agent, e.g, a double stranded RNAi agent, may be done in vitro or in vivo. Contacting a cell in vivo with the RNAi agent includes contacting a cell or group of cells within a subject, e.g., a human subject, with the RNAi agent. Combinations of in vitro and in vivo methods of contacting a cell or a group of cells are also possible. Contacting a cell or a group of cells may be direct or indirect. Thus, for example, the RNAi agent may be put into physical contact with the cell by the individual performing the method, or alternatively, the RNAi agent may be put into a situation that will permit or cause it to subsequently come into contact with the cell. Furthermore, contacting a cell or a group of cells may be accomplished via a targeting ligand, including any ligand described herein or known in the art. In preferred embodiments, the targeting ligand is a carbohydrate moiety, e.g., a GalNAc$_3$ ligand, or any other ligand that directs the RNAi agent to a site of interest, e.g., the liver of a subject.

Contacting a cell in vitro may be done, for example, by incubating the cell with the RNAi agent. Contacting a cell in vivo may be done, for example, by injecting the RNAi agent into or near the tissue where the cell is located, or by injecting the RNAi agent into another area, e.g., the bloodstream or the subcutaneous space, such that the agent will subsequently reach the tissue where the cell to be contacted is located. For example, the RNAi agent may contain and/or be coupled to a ligand, e.g., GalNAc3, that directs the RNAi agent to a site of interest, e.g., the liver. Combinations of in vitro and in vivo methods of contacting are also possible. For example, a cell may also be contacted in vitro with an RNAi agent and subsequently transplanted into a subject.

The term "inhibiting," as used herein, is used interchangeably with "reducing," "silencing," "downregulating", "suppressing", and other similar terms, and includes any level of inhibition. Preferably inhibiting includes a statistically significant or clinically significant inhibition.

The phrase "inhibiting expression of a C3 gene" is intended to refer to inhibition of expression of any C3 gene (such as, e.g., a mouse C3 gene, a rat C3 gene, a monkey C3 gene, or a C3 gene) as well as variants or mutants of aC3 gene.

The phrase "inhibiting expression of a C3 gene" is intended to refer to inhibition of expression of any C3 gene (such as, e.g., a mouse C3 gene, a rat C3 gene, a monkey C3 gene, or a human C3 gene) as well as variants or mutants of a C3 gene. Thus, the C3 gene may be a wild-type C3 gene, a mutant C3 gene (such as a mutant C3 gene), or a transgenic C3 gene in the context of a genetically manipulated cell, group of cells, or organism.

"Inhibiting expression of a C3 gene" includes any level of inhibition of a C3 gene, e.g., at least partial suppression of the expression of a C3 gene. The expression of the C3 gene may be assessed based on the level, or the change in the level, of any variable associated with C3 gene expression, e.g., C3 mRNA level, C3 protein level, or the severity of a C3-associated disease. This level may be assessed in an individual cell or in a group of cells, including, for example, a sample derived from a subject.

In some embodiments of the methods of the invention, expression of a target gene, e.g., C3 gene, is inhibited by at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99%%, or to below the level of detection of the assay. In some embodiments, the inhibition of expression of a C3 gene results in normalization of the level of the C3 gene such that the difference between the level before treatment and a normal control level is reduced by at least 30%, 35%, 40%, 45%, 50%, 55%, 60%, 65%, 70%, 75%, 80%, 85%, 90%, or 95%. In some embodiments, the inhibition is a clinically relevant inhibition.

Inhibition of the expression of the target gene, e.g., a C3, gene may be manifested by a reduction of the amount of mRNA expressed by a first cell or group of cells (such cells may be present, for example, in a sample derived from a subject) in which a target gene is transcribed and which has or have been treated (e.g., by contacting the cell or cells with an RNAi agent of the invention, or by administering an RNAi agent of the invention to a subject in which the cells are or were present) such that the expression of a target gene is inhibited, as compared to a second cell or group of cells substantially identical to the first cell or group of cells but which has not or have not been so treated (control cell(s)). In preferred embodiments, the inhibition is assessed by the rtPCR method provided in Example 2, with in vitro assays being performed in an appropriately matched cell line with the duplex at a 10 nM concentration, and expressing the level of mRNA in treated cells as a percentage of the level of mRNA in control cells, using the following formula:

$$\frac{(mRNA \text{ in control cells}) - (mRNA \text{ in treated cells})}{(mRNA \text{ in control cells})} \cdot 100\%$$

Alternatively, inhibition of the expression of a C3 gene may be assessed in terms of a reduction of a parameter that is functionally linked to C3 gene expression, e.g., C3 protein expression. C3 gene silencing may be determined in any cell expressing a C3 gene, either constitutively or by genomic engineering, and by any assay known in the art.

Inhibition of the expression of a complement component C3 protein may be manifested by a reduction in the level of the protein that is expressed by a cell or group of cells (e.g., the level of protein expressed in a sample derived from a subject). As explained above for the assessment of mRNA suppression, the inhibition of protein expression levels in a treated cell or group of cells may similarly be expressed as a percentage of the level of protein in a control cell or group of cells.

A control cell or group of cells that may be used to assess the inhibition of the expression of a target gene includes a cell or group of cells that has not yet been contacted with an RNAi agent of the invention. For example, the control cell or group of cells may be derived from an individual subject (e.g., a human or animal subject) prior to treatment of the subject with an RNAi agent. In alternative embodiments, the level may be compared to an appropriate control sample, e.g., a known population control sample.

The level of C3 mRNA that is expressed by a cell or group of cells may be determined using any method known in the art for assessing mRNA expression. In one embodiment, the level of expression of C3 in a sample is determined by detecting a transcribed polynucleotide, or portion thereof, e.g., mRNA of the C3 gene. RNA may be extracted from cells using RNA extraction techniques including, for example, using acid phenol/guanidine isothiocyanate extraction (RNAzol B; Biogenesis), RNeasy RNA preparation kits (Qiagen) or PAXgene (PreAnalytix, Switzerland). Typical assay formats utilizing ribonucleic acid hybridization include nuclear run-on assays, RT-PCR, RNase protection assays (Melton et al., Nuc. Acids Res. 12:7035), Northern blotting, in situ hybridization, and microarray analysis. Circulating C3 mRNA may be detected using methods the described in PCT Publication No. WO 2012/177906, the entire contents of which are hereby incorporated herein by reference.

In one embodiment, the level of expression of C3 is determined using a nucleic acid probe. The term "probe", as used herein, refers to any molecule that is capable of selectively binding to a specific C3. Probes can be synthesized by one of skill in the art, or derived from appropriate biological preparations. Probes may be specifically designed to be labeled. Examples of molecules that can be utilized as probes include, but are not limited to, RNA, DNA, proteins, antibodies, and organic molecules.

Isolated mRNA can be used in hybridization or amplification assays that include, but are not limited to, Southern or Northern analyses, polymerase chain reaction (PCR) analyses and probe arrays. One method for the determination of mRNA levels involves contacting the isolated mRNA with a nucleic acid molecule (probe) that can hybridize, e.g., specifically hybridize, to C3 mRNA. In one embodiment, the mRNA is immobilized on a solid surface and contacted with a probe, for example by running the isolated mRNA on an agarose gel and transferring the mRNA from the gel to a membrane, such as nitrocellulose. In an alternative embodiment, the probe(s) are immobilized on a solid surface and the mRNA is contacted with the probe(s), for example, in an Affymetrix gene chip array. A skilled artisan can readily adapt known mRNA detection methods for use in determining the level of C3 mRNA.

An alternative method for determining the level of expression of C3 in a sample involves the process of nucleic acid amplification and/or reverse transcriptase (to prepare cDNA) of for example mRNA in the sample, e.g., by RT-PCR (the experimental embodiment set forth in Mullis, 1987, U.S. Pat. No. 4,683,202), ligase chain reaction (Barany (1991) Proc. Natl. Acad. Sci. USA 88:189-193), self sustained sequence replication (Guatelli et al. (1990) Proc. Natl. Acad. Sci. USA 87:1874-1878), transcriptional amplification system (Kwoh et al. (1989) Proc. Natl. Acad. Sci. USA 86:1173-1177), Q-Beta Replicase (Lizardi et al. (1988) Bio/Technology 6:1197), rolling circle replication (Lizardi et al., U.S. Pat. No. 5,854,033) or any other nucleic acid amplification method, followed by the detection of the amplified molecules using techniques well known to those of skill in the art. These detection schemes are especially useful for the detection of nucleic acid molecules if such molecules are present in very low numbers. In particular aspects of the invention, the level of expression of C3 is determined by quantitative fluorogenic RT-PCR (i.e., the TaqMan™ System).

The expression levels of C3 mRNA may be monitored using a membrane blot (such as used in hybridization analysis such as Northern, Southern, dot, and the like), or microwells, sample tubes, gels, beads or fibers (or any solid support comprising bound nucleic acids). See U.S. Pat. Nos. 5,770,722, 5,874,219, 5,744,305, 5,677,195 and 5,445,934, which are incorporated herein by reference. The determination of C3 expression level may also comprise using nucleic acid probes in solution.

In preferred embodiments, the level of C3 mRNA expression is assessed using branched DNA (bDNA) assays or real time PCR (qPCR). The use of these methods is described and exemplified in the Examples presented herein.

The level of C3 protein expression may be determined using any method known in the art for the measurement of protein levels. Such methods include, for example, electrophoresis, capillary electrophoresis, high performance liquid chromatography (HPLC), thin layer chromatography (TLC), hyperdiffusion chromatography, fluid or gel precipitin reactions, absorption spectroscopy, a colorimetric assays, spectrophotometric assays, flow cytometry, immunodiffusion (single or double), immunoelectrophoresis, Western blotting, radioimmunoassay (RIA), enzyme-linked immunosorbent assays (ELISAs), immunofluorescent assays, electrochemiluminescence assays, and the like.

In some embodiments, the efficacy of the methods of the invention can be monitored by detecting or monitoring a reduction in a symptom of a C3-associated disease. Symptoms may be assessed in vitro or in vivo using any method known in the art.

The term "sample" as used herein refers to a collection of similar fluids, cells, or tissues isolated from a subject, as well as fluids, cells, or tissues present within a subject. Examples of biological fluids include blood, serum and serosal fluids, plasma, lymph, urine, cerebrospinal fluid, saliva, ocular fluids, and the like. Tissue samples may include samples from tissues, organs or localized regions. For example, samples may be derived from particular organs, parts of organs, or fluids or cells within those organs. In certain embodiments, samples may be derived from the liver (e.g., whole liver or certain segments of liver or certain types of cells in the liver, such as, e.g., hepatocytes), the retina or parts or parts of the retina (e.g., retinal pigment epithelium), the central nervous system or parts of the central nervous system (e.g., ventricles or choroid plexus), or the pancreas or certain cells or parts of the pancreas. In preferred embodiments, a "sample derived from a subject" refers to blood drawn from the subject or plasma derived therefrom. In further embodiments, a "sample derived from a subject" refers to liver tissue (or subcomponents thereof) or retinal tissue (or subcomponents thereof) derived from the subject.

In some embodiments of the methods of the invention, the RNAi agent is administered to a subject such that the RNAi agent is delivered to a specific site within the subject. The inhibition of expression of C3 may be assessed using measurements of the level or change in the level of C3 mRNA and/or C3 protein in a sample derived from fluid or tissue from the specific site within the subject. In preferred embodiments, the site is the liver. The site may also be a subsection or subgroup of cells from any one of the aforementioned sites. The site may also include cells that express a particular type of receptor.

VIII. Methods for Treating or Preventing a Complement Component C3-Associated Disease or Disorder The present invention provides therapeutic and prophylactic methods which include administering to a subject having a complement component C3-associated disease, as described herein, e.g., paroxysmal nocturnal hemoglobinuria (PNH), atypical hemolytic uremic syndrome (aHUS), atypical hemolytic uremic syndrome (aHUS), neuromyelitis optica (NMO), multifocal motor neuropathy (MMN), myasthenia gravis (MG), C3 glomerulonephritis, or systemic lupus erythomatosis, an iRNA agent, pharmaceutical composition comprising an iRNA agent, or vector comprising an iRNA of the invention.

In one aspect, the present invention provides methods of treating a subject having a disorder that would benefit from reduction in C3 expression, e.g., "a complement component C3-associated disease," e.g., paroxysmal nocturnal hemoglobinuria (PNH), atypical hemolytic uremic syndrome (aHUS), atypical hemolytic uremic syndrome (aHUS), neuromyelitis optica (NMO), multifocal motor neuropathy (MMN), myasthenia gravis (MG), or C3 glomerulonephritis, or systemic lupus erythomatosis. The treatment methods (and uses) of the invention include administering to the subject, e.g., a human, a therapeutically effective amount of an iRNA agent targeting a C3 gene or a pharmaceutical composition comprising an iRNA agent targeting a C3 gene, thereby treating the subject having a disorder that would benefit from reduction in C3 expression.

In one aspect, the invention provides methods of preventing at least one symptom in a subject having a disorder that would benefit from reduction in C3 expression, e.g., a complement component C3-associated disease, e.g., paroxysmal nocturnal hemoglobinuria (PNH), atypical hemolytic uremic syndrome (aHUS), atypical hemolytic uremic syndrome (aHUS), neuromyelitis optica (NMO), multifocal motor neuropathy (MMN), myasthenia gravis (MG), C3 glomerulonephritis, or systemic lupus erythomatosis. The methods include administering to the subject a therapeutically effective amount of the iRNA agent, e.g., dsRNA, or vector of the invention, thereby preventing at least one symptom in the subject having a disorder that would benefit from reduction in C3 expression. For example, the invention provides methods for preventing hemolysis in a subject suffering from a disorder that would benefit from reduction in C3 expression, e.g., a complement component C3-associated disease, e.g., paroxysmal nocturnal hemoglobinuria (PNH), atypical hemolytic uremic syndrome (aHUS), atypical hemolytic uremic syndrome (aHUS), neuromyelitis optica (NMO), multifocal motor neuropathy (MMN), myasthenia gravis (MG), C3 glomerulonephritis, or systemic lupus erythomatosis.

In another aspect, the present invention provides uses of a therapeutically effective amount of an iRNA agent of the invention for treating a subject, e.g., a subject that would benefit from a reduction and/or inhibition of C3 expression.

In yet another aspect, the present invention provides uses of an iRNA agent, e.g., a dsRNA, of the invention targeting a C3 gene or a pharmaceutical composition comprising an iRNA agent targeting a C3 gene in the manufacture of a medicament for treating a subject, e.g., a subject that would benefit from a reduction and/or inhibition of C3 expression, such as a subject having a disorder that would benefit from reduction in C3 expression, e.g., a complement component C3-associated disease, e.g., paroxysmal nocturnal hemoglobinuria (PNH), atypical hemolytic uremic syndrome (aHUS), atypical hemolytic uremic syndrome (aHUS), neuromyelitis optica (NMO), multifocal motor neuropathy (MMN), myasthenia gravis (MG), C3 glomerulonephritis, or systemic lupus erythmatosis.

In another aspect, the invention provides uses of an iRNA, e.g., a dsRNA, of the invention for preventing at least one symptom in a subject suffering from a disorder that would benefit from a reduction and/or inhibition of C3 expression, such as a complement component C3-associated disease, e.g., paroxysmal nocturnal hemoglobinuria (PNH), atypical hemolytic uremic syndrome (aHUS), atypical hemolytic uremic syndrome (aHUS), neuromyelitis optica (NMO), multifocal motor neuropathy (MMN), myasthenia gravis (MG), C3 glomerulonephritis, or systemic lupus erythmatosis.

In a further aspect, the present invention provides uses of an iRNA agent of the invention in the manufacture of a medicament for preventing at least one symptom in a subject suffering from a disorder that would benefit from a reduction and/or inhibition of C3 expression, such as a complement component C3-associated disease, e.g., paroxysmal nocturnal hemoglobinuria (PNH), atypical hemolytic uremic syndrome (aHUS), atypical hemolytic uremic syndrome (aHUS), neuromyelitis optica (NMO), multifocal motor neuropathy (MMN), myasthenia gravis (MG), C3 glomerulonephritis, or systemic lupus erythmatosis.

In one embodiment, an iRNA agent targeting C3 is administered to a subject having C3-associated disease such that the expression of a C3 gene, e.g., in a cell, tissue, blood or other tissue or fluid of the subject are reduced by at least about 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 62%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or at least about 99% or more, or to a level below the level of detection of the assay, when the dsRNA agent is administered to the subject.

The methods and uses of the invention include administering a composition described herein such that expression of the target C3 gene is decreased for an extended duration, e.g., at least one month, preferably at least three months.

Administration of the dsRNA according to the methods and uses of the invention may result in a reduction of the severity, signs, symptoms, and/or markers of such diseases or disorders in a patient with a C3-associated disease. By "reduction" in this context is meant a statistically or clinically significant decrease in such level. The reduction can be, for example, at least about 5%, 10%, 15%, 20%, 25%, 30%, 35%, 40%, 45%, 50%, 55%, 60%, 65%, 70%, 75%, 80%, 85%, 90%, 95%, or about 100%.

Efficacy of treatment or prevention of disease can be assessed, for example by measuring hemolysis, disease progression, disease remission, symptom severity, reduction in pain, quality of life, dose of a medication required to sustain a treatment effect, level of a disease marker or any other measurable parameter appropriate for a given disease being treated or targeted for prevention. It is well within the ability of one skilled in the art to monitor efficacy of treatment or prevention by measuring any one of such parameters, or any combination of parameters. Comparison of the later readings with the initial readings, or historically relevant population controls, provide a physician an indication of whether the treatment is effective. It is well within the ability of one skilled in the art to monitor efficacy of treatment or prevention by measuring any one of such parameters, or any combination of parameters. In connection with the administration of an iRNA targeting a C3 or pharmaceutical composition thereof, "effective against" a C3-associated disease indicates that administration in a clinically appropriate manner results in a beneficial effect for at least a statistically significant fraction of patients, such as improvement of symptoms, a cure, a reduction in disease, extension of life, improvement in quality of life, or other effect generally recognized as positive by medical doctors familiar with treating a C3-associated disease and the related causes.

A treatment or preventive effect is evident when there is a statistically significant improvement in one or more parameters of disease status, or by a failure to worsen or to develop symptoms where they would otherwise be anticipated. As an example, a favorable change of at least 10% in a measurable parameter of disease, and preferably at least 20%, 30%, 40%, 50% or more can be indicative of effective treatment. Efficacy for a given iRNA drug or formulation of that drug can also be judged using an experimental animal model for the given disease as known in the art. When using an experimental animal model, efficacy of treatment is evidenced when a statistically significant reduction in a marker or symptom is observed.

Subjects can be administered a therapeutic amount of iRNA, such as about 0.01 mg/kg to about 200 mg/kg. Values and ranges intermediate to the recited values are also intended to be part of this invention.

The iRNA can be administered by intravenous infusion over a period of time, on a regular basis, e.g., once per month, once every other month, once per quarter.

In certain embodiments, one or more loading doses is administered.

Administration of the iRNA can reduce the presence of C3 protein, e.g., in a cell, tissue, blood, urine or other compartment of the patient by at least about 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or at least about 99% or more, or below the level of detection of the assay method used.

Before administration of a full dose of the iRNA, patients can be administered a smaller dose, such as a 5% infusion, and monitored for adverse effects, such as an allergic reaction. In another example, the patient can be monitored for unwanted immunostimulatory effects, such as increased cytokine (e.g., TNF-alpha or INF-alpha) levels.

Owing to the inhibitory effects on C3 gene expression, a composition according to the invention or a pharmaceutical composition prepared therefrom can enhance the quality of life.

An iRNA of the invention may be administered in "naked" form, where the modified or unmodified iRNA agent is directly suspended in aqueous or suitable buffer solvent, as a "free iRNA." A free iRNA is administered in the absence of a pharmaceutical composition. The free iRNA may be in a suitable buffer solution. The buffer solution may comprise acetate, citrate, prolamine, carbonate, or phosphate, or any combination thereof. In one embodiment, the buffer solution is phosphate buffered saline (PBS). The pH and osmolarity of the buffer solution containing the iRNA can be adjusted such that it is suitable for administering to a subject.

Alternatively, an iRNA of the invention may be administered as a pharmaceutical composition, such as a dsRNA liposomal formulation.

Subjects that would benefit from a reduction and/or inhibition of C3 gene expression are those having a C3-associated disease or disorder as described herein.

Treatment of a subject that would benefit from a reduction and/or inhibition of C3 gene expression includes therapeutic and prophylactic treatment.

Subjects that would benefit from a reduction and/or inhibition of C3 gene expression are those having a complement component C3-associated disease or disorder as described herein.

In one embodiment, a complement component C3-associated disease is paroxysmal nocturnal hemoglobinuria (PNH). The PNH may be classical PNH or PNH in the setting of another bone marrow failure syndrome and/or myelodysplastic syndromes (MDS), e.g., cytopenias.

In another embodiment, a complement component C3-associated disease is atypical hemolytic uremic syndrome (aHUS).

In another embodiment, a complement component C3-associated disease is neuromyelitis optica (NMO). NMO is the co-occurrence of optic neuritis with myelitis. In some embodiments, a subject having NMO may also have multiple sclerosis (MS); acute disseminated encephalomyelitis (ADEM); systemic lupus erythematosus (SLE); Sjögren syndrome; a viral infection; or a bacterial infection.

In yet another embodiment, a complement component C3-associated disease is multifocal motor neuropathy (MMN).

In another embodiment, a complement component C3-associated disease is myasthenia gravis (MG). The MG may be an ocular form of MG, a generalized form of MG, or a combination of ocular and generalized MG.

In another embodiment, a complement component C3-associated disease is C3 glomerulonephritis.

In one embodiment, a complement component C3-associated disease is systemic lupus erythmatosis.

The invention further provides methods and uses of an iRNA agent or a pharmaceutical composition thereof for treating a subject that would benefit from reduction and/or inhibition of C3 gene expression, e.g., a subject having a C3-associated disease, in combination with other pharmaceuticals and/or other therapeutic methods, e.g., with known pharmaceuticals and/or known therapeutic methods, such as, for example, those which are currently employed for treating these disorders.

Accordingly, in some aspects of the invention, the methods which include either a single iRNA agent of the invention, further include administering to the subject one or more additional therapeutic agents.

The iRNA agent and an additional therapeutic agent and/or treatment may be administered at the same time and/or in the same combination, e.g., parenterally, or the additional therapeutic agent can be administered as part of a separate composition or at separate times and/or by another method known in the art or described herein.

For example, additional therapeutics and therapeutic methods suitable for treating a subject that would benefit from reducton in C3 expression, e.g., a subject having a complement component C3-associated disease, include plasmaphoresis, thrombolytic therapy (e.g., streptokinase), antiplatelet agents, folic acid, corticosteroids; immunosuppressive agents; estrogens, methotrexate, 6-MP, azathioprine sulphasalazine, mesalazine, olsalazine, chloroquinine/hydroxychloroquine, pencillamine, aurothiomalate (intramuscular and oral), azathioprine, cochicine, corticosteroids (oral, inhaled and local injection), beta-2 adrenoreceptor agonists (salbutamol, terbutaline, salmeteral), xanthines (theophylline, aminophylline), cromoglycate, nedocromil, ketotifen, ipratropium and oxitropium, cyclosporin, FK506, rapamycin, mycophenolate mofetil, leflunomide, NSAIDs, for example, ibuprofen, corticosteroids such as prednisolone, phosphodiesterase inhibitors, adensosine agonists, antithrombotic agents, complement inhibitors, adrenergic agents, agents which interfere with signalling by proinflammatory cytokines, such as TNF-α or IL-1 (e.g., IRAK, NIK, IKK, p38 or MAP kinase inhibitors), IL-1β converting enzyme inhibitors, TNFα converting enzyme (TACE) inhibitors, T-cell signalling inhibitors, such as kinase inhibitors, metalloproteinase inhibitors, sulfasalazine, azathioprine, 6-mercaptopurines, angiotensin converting enzyme inhibitors, soluble cytokine receptors and derivatives thereof (e.g., soluble p55 or p75 TNF receptors and the derivatives p75TNFRIgG (Enbrel™ and p55TNFRIgG (Lenercept)), sIL-1RI, sIL-1RII, and sIL-6R), antiinflammatory cytokines (e.g., IL-4, IL-10, IL-11, IL-13 and TGFβ), celecoxib, folic acid, hydroxychloroquine sulfate, rofecoxib, etanercept, infliximonoclonal antibody, naproxen, valdecoxib, sulfasalazine, methylprednisolone, meloxicam, methylprednisolone acetate, gold sodium thiomalate, aspirin, triamcinolone acetonide, propoxyphene napsylate/apap, folate, nabumetone, diclofenac, piroxicam, etodolac, diclofenac sodium, oxaprozin, oxycodone hydrochloride, hydrocodone bitartrate/apap, diclofenac sodium/misoprostol, fentanyl, anakinra, human recombinant, tramadol hydrochloride, salsalate, sulindac, cyanocobalamin/folic acid/pyridoxine, acetaminophen, alendronate sodium, prednisolone, morphine sulfate, lidocaine hydrochloride, indomethacin, glucosamine sulf/chondroitin, amitriptyline hydrochloride, sulfadiazine, oxycodone hydrochloride/acetaminophen, olopatadine hydrochloride, misoprostol, naproxen sodium, omeprazole, cyclophosphamide, rituximonoclonal antibody, IL-1 TRAP, MRA, CTLA4-IG, IL-18 BP, anti-IL-18, Anti-IL15, BIRB-796, SCIO-469, VX-702, AMG-548, VX-740, Roflumilast, IC-485, CDC-801, Mesopram, cyclosporine, cytokine suppressive anti-inflammatory drug(s) (CSAIDs); CDP-571/BAY-10-3356 (humanized anti-TNFα antibody; Celltech/Bayer); cA2/infliximonoclonal antibody (chimeric anti-TNFα antibody; Centocor); 75 kdTNFR-IgG/etanercept (75 kD TNF receptor-IgG fusion protein; Immunex; see e.g., (1994) Arthr. Rheum. 37: S295; (1996) J. Invest. Med. 44: 235A); 55 kdTNF-IgG (55 kD TNF receptor-IgG fusion protein; Hoffmann-LaRoche); IDEC-CE9.1/SB 210396 (non-depleting primatized anti-CD4 antibody; IDEC/SmithKline; see e.g., (1995) Arthr. Rheum. 38: S185); DAB 486-IL-2 and/or DAB 389-IL-2 (IL-2 fusion proteins; Seragen; see e.g., (1993) Arthrit. Rheum. 36: 1223); Anti-Tac (humanized anti-IL-2Rα; Protein Design Labs/Roche); IL-4 (anti-inflammatory cytokine; DNAX/Schering); IL-10 (SCH 52000; recombinant IL-10, anti-inflammatory cytokine; DNAX/Schering); IL-4; IL-10 and/or IL-4 agonists (e.g., agonist antibodies); IL-1RA (IL-1 receptor antagonist; Synergen/Amgen); anakinra (Kineret®/Amgen); TNF-bp/s-

TNF (soluble TNF binding protein; see e.g., (1996) Arthr. Rheum. 39(9 (supplement)): 5284; (1995) Amer. J. Physiol.—Heart and Circ. Physiol. 268: 37-42); R973401 (phosphodiesterase Type IV inhibitor; see e.g., (1996) Arthr. Rheum. 39(9 (supplement): S282); MK-966 (COX-2 Inhibitor; see e.g., (1996) Arthr. Rheum. 39(9 (supplement): S81); Iloprost (see e.g., (1996) Arthr. Rheum. 39(9 (supplement): S82); methotrexate; thalidomide (see e.g., (1996) Arthr. Rheum. 39(9 (supplement): 5282) and thalidomide-related drugs (e.g., Celgen); leflunomide (anti-inflammatory and cytokine inhibitor; see e.g., (1996) Arthr. Rheum. 39(9 (supplement): 5131; (1996) Inflamm. Res. 45: 103-107); tranexamic acid (inhibitor of plasminogen activation; see e.g., (1996) Arthr. Rheum. 39(9 (supplement): S284); T-614 (cytokine inhibitor; see e.g., (1996) Arthr. Rheum. 39(9 (supplement): S282); prostaglandin E1 (see e.g., (1996) Arthr. Rheum. 39(9 (supplement): S282); Tenidap (non-steroidal anti-inflammatory drug; see e.g., (1996) Arthr. Rheum. 39(9 (supplement): S280); Naproxen (non-steroidal anti-inflammatory drug; see e.g., (1996) Neuro. Report 7: 1209-1213); Meloxicam (non-steroidal anti-inflammatory drug); Ibuprofen (non-steroidal anti-inflammatory drug); Piroxicam (non-steroidal anti-inflammatory drug);

Diclofenac (non-steroidal anti-inflammatory drug); Indomethacin (non-steroidal anti-inflammatory drug); Sulfasalazine (see e.g., (1996) Arthr. Rheum. 39(9 (supplement): S281); Azathioprine (see e.g., (1996) Arthr. Rheum. 39(9 (supplement): S281); ICE inhibitor (inhibitor of the enzyme interleukin-113 converting enzyme); zap-70 and/or lck inhibitor (inhibitor of the tyrosine kinase zap-70 or lck); VEGF inhibitor and/or VEGF-R inhibitor (inhibitors of vascular endothelial cell growth factor or vascular endothelial cell growth factor receptor; inhibitors of angiogenesis); corticosteroid anti-inflammatory drugs (e.g., SB203580); TNF-convertase inhibitors; anti-IL-12 antibodies; anti-IL-18 antibodies; interleukin-11 (see e.g., (1996) Arthr. Rheum. 39(9 (supplement): S296); interleukin-13 (see e.g., (1996) Arthr. Rheum. 39(9 (supplement): S308); interleukin-17 inhibitors (see e.g., (1996) Arthr. Rheum. 39(9 (supplement): S120); gold; penicillamine; chloroquine; chlorambucil; hydroxychloroquine; cyclosporine; cyclophosphamide; total lymphoid irradiation; anti-thymocyte globulin; anti-CD4 antibodies; CD5-toxins; orally-administered peptides and collagen; lobenzarit disodium; Cytokine Regulating Agents (CRAs) HP228 and HP466 (Houghten Pharmaceuticals, Inc.); ICAM-1 antisense phosphorothioate oligo-deoxynucleotides (ISIS 2302; Isis Pharmaceuticals, Inc.); soluble complement receptor 1 (TP10; T Cell Sciences, Inc.); prednisone; orgotein; glycosaminoglycan polysulphate; minocycline; anti-IL2R antibodies; marine and botanical lipids (fish and plant seed fatty acids; see e.g., DeLuca et al. (1995) Rheum. Dis. Clin. North Am. 21: 759-777); auranofin; phenylbutazone; meclofenamic acid; flufenamic acid; intravenous immune globulin; zileuton; azaribine; mycophenolic acid (RS-61443); tacrolimus (FK-506); sirolimus (rapamycin); amiprilose (therafectin); cladribine (2-chlorodeoxyadenosine); methotrexate; bcl-2 inhibitors (see Bruncko, M. et al. (2007) J. Med. Chem. 50(4): 641-662); antivirals and immune-modulating agents, small molecule inhibitor of KDR, small molecule inhibitor of Tie-2; methotrexate; prednisone; celecoxib; folic acid; hydroxychloroquine sulfate; rofecoxib; etanercept; infliximonoclonal antibody; leflunomide; naproxen; valdecoxib; sulfasalazine; methylprednisolone; ibuprofen; meloxicam; methylprednisolone acetate; gold sodium thiomalate; aspirin; azathioprine; triamcinolone acetonide; propxyphene napsylate/apap; folate; nabumetone; diclofenac; piroxicam; etodolac; diclofenac sodium; oxaprozin; oxycodone hcl; hydrocodone bitartrate/apap; diclofenac sodium/misoprostol; fentanyl; anakinra, human recombinant; tramadol hcl; salsalate; sulindac; cyanocobalamin/fa/pyridoxine; acetaminophen; alendronate sodium; prednisolone; morphine sulfate; lidocaine hydrochloride; indomethacin; glucosamine sulfate/chondroitin; cyclosporine; amitriptyline hydrochloride; sulfadiazine; oxycodone hcl/acetaminophen; olopatadine hcl; misoprostol; naproxen sodium; omeprazole; mycophenolate mofetil; cyclophosphamide; rituximonoclonal antibody; IL-1 TRAP; MRA; CTLA4-IG; IL-18 BP; IL-12/23; anti-IL 18; anti-IL 15; BIRB-796; SC10-469; VX-702; AMG-548; VX-740; Roflumilast; IC-485; CDC-801; mesopram, albuterol, salmeterol/fluticasone, montelukast sodium, fluticasone propionate, budesonide, prednisone, salmeterol xinafoate, levalbuterol hcl, albuterol sulfate/ipratropium, prednisolone sodium phosphate, triamcinolone acetonide, beclomethasone dipropionate, ipratropium bromide, azithromycin, pirbuterol acetate, prednisolone, theophylline anhydrous, methylprednisolone sodium succinate, clarithromycin, zafirlukast, formoterol fumarate, influenza virus vaccine, methylprednisolone, amoxicillin trihydrate, flunisolide, allergy injection, cromolyn sodium, fexofenadine hydrochloride, flunisolide/menthol, amoxicillin/clavulanate, levofloxacin, inhaler assist device, guaifenesin, dexamethasone sodium phosphate, moxifloxacin hcl, doxycycline hyclate, guaifenesin/d-methorphan, p-ephedrine/cod/chlorphenir, gatifloxacin, cetirizine hydrochloride, mometasone furoate, salmeterol xinafoate, benzonatate, cephalexin, pe/hydrocodone/chlorphenir, cetirizine hcl/pseudoephed, phenylephrine/cod/promethazine, codeine/promethazine, cefprozil, dexamethasone, guaifenesin/pseudoephedrine, chlorpheniramine/hydrocodone, nedocromil sodium, terbutaline sulfate, epinephrine, methylprednisolone, metaproterenol sulfate, aspirin, nitroglycerin, metoprolol tartrate, enoxaparin sodium, heparin sodium, clopidogrel bisulfate, carvedilol, atenolol, morphine sulfate, metoprolol succinate, warfarin sodium, lisinopril, isosorbide mononitrate, digoxin, furosemide, simvastatin, ramipril, tenecteplase, enalapril maleate, torsemide, retavase, losartan potassium, quinapril hcl/mag carb, bumetanide, alteplase, enalaprilat, amiodarone hydrochloride, tirofiban hcl m-hydrate, diltiazem hydrochloride, captopril, irbesartan, valsartan, propranolol hydrochloride, fosinopril sodium, lidocaine hydrochloride, eptifibatide, cefazolin sodium, atropine sulfate, aminocaproic acid, spironolactone, interferon, sotalol hydrochloride, potassium chloride, docusate sodium, dobutamine hcl, alprazolam, pravastatin sodium, atorvastatin calcium, midazolam hydrochloride, meperidine hydrochloride, isosorbide dinitrate, epinephrine, dopamine hydrochloride, bivalirudin, rosuvastatin, ezetimibe/simvastatin, avasimibe, and cariporide.

In some aspects, the additional therapeutic agent is an iRNA agent targeting a C5 gene, such as described in U.S. Pat. No. 9,249,415, U.S. Provisional Patent Application Nos. 62/174,933, filed on Jun. 12, 2015, 62/263,066, filed on Dec. 4, 2015, the entire contents of each of which are hereby incorporated herein by reference.

In other aspects, the additional therapeutic agent is an anti-complement component C5 antibody, or antigen-binding fragment thereof (e.g., eculizumab). Eculizumab is a humanized monoclonal IgG2/4, kappa light chain antibody that specifically binds complement component C5 with high affinity and inhibits cleavage of C5 to C5a and C5b, thereby inhibiting the generation of the terminal complement complex C5b-9. Eculizumab is described in U.S. Pat. No. 6,355,245, the entire contents of which are incorporated herein by reference.

In yet other aspects, the additional therapeutic is a C3 peptide inhibitor, or analog thereof. In one embodiment, the C3 peptide inhibitor is compstatin. Compstatin is a cyclic tridecapeptide with potent and selective C3 inhibitory activity. Compstatin, and its analogs, are described in U.S. Pat. Nos. 7,888,323, 7,989,589, and 8,442,776, in U.S. Patent Publication No. 2012/0178694 and 2013/0053302, and in PCT Publication Nos. WO 2012/174055, WO 2012/2178083, WO 2013/036778, the entire contents of each of which are incorporated herein by reference.

Accordingly, in one aspect, the present invention provides methods of treating a subject having a disorder that would benefit from reduction in C3 expression, e.g., a complement component C3-associated disease, e.g., paroxysmal nocturnal hemoglobinuria (PNH), atypical hemolytic uremic syndrome (aHUS), atypical hemolytic uremic syndrome (aHUS), neuromyelitis optica (NMO), multifocal motor neuropathy (MMN), myasthenia gravis (MG), C3 glomerulonephritis, or systemic lupus erythematosis, which include administering to the subject, e.g., a human, a therapeutically effective amount of an iRNA agent targeting a C3 gene or a pharmaceutical composition comprising an iRNA agent targeting a C3 gene, and an additional therapeutic agent, such as an anti-complement component C5 antibody, or antigen-binding fragment thereof (e.g., eculizumab), an iRNA agent targeting complement component C5, and/or a C3 peptide inhibitor (e.g., compstatin), thereby treating the subject having a disorder that would benefit from reduction in C3 expression.

In another aspect, the invention provides methods of preventing at least one symptom in a subject having a disorder that would benefit from reduction in C3 expression, e.g., a complement component C3-associated disease, e.g., paroxysmal nocturnal hemoglobinuria (PNH), atypical hemolytic uremic syndrome (aHUS), neuromyelitis optica (NMO), multifocal motor neuropathy (MMN), myasthenia gravis (MG), C3 glomerulonephritis, or systemic lupus erythematosis. The methods include administering to the subject a therapeutically effective amount of the iRNA agent, e.g., dsRNA, or vector of the invention, and an additional therapeutic agent, such as an anti-complement component C5 antibody, or antigen-binding fragment thereof (e.g., eculizumab), an iRNA agent targeting complement component C5, and/or a C3 peptide inhibitor (e.g., compstatin), thereby preventing at least one symptom in the subject having a disorder that would benefit from reduction in C3 expression.

In another aspect, the present invention provides uses of a therapeutically effective amount of an iRNA agent of the invention and an additional therapeutic agent, such as an anti-complement component C5 antibody, or antigen-binding fragment thereof (e.g., eculizumab), an iRNA agent targeting complement component C5, and/or a C3 peptide inhibitor (e.g., comstatin), for treating a subject, e.g., a subject that would benefit from a reduction and/or inhibition of C3 expression.

In another aspect, the present invention provides uses of an iRNA agent, e.g., a dsRNA, of the invention targeting a C3 gene or a pharmaceutical composition comprising an iRNA agent targeting a C3 gene in the manufacture of a medicament for use in combination with an additional therapeutic agent, such as an anti-complement component C5 antibody, or antigen-binding fragment thereof (e.g., eculizumab), an iRNA agent targeting complement component C5, and/or a C3 peptide inhibitor (e.g., compstatin), for treating a subject, e.g., a subject that would benefit from a reduction and/or inhibition of C3 expression, e.g., a complement component C3-associated disease, e.g., paroxysmal nocturnal hemoglobinuria (PNH), atypical hemolytic uremic syndrome (aHUS), atypical hemolytic uremic syndrome (aHUS), neuromyelitis optica (NMO), multifocal motor neuropathy (MMN), myasthenia gravis (MG), C3 glomerulonephritis, or systemic lupus erythematosis.

In yet another aspect, the invention provides uses of an iRNA agent, e.g., a dsRNA, of the invention, and an additional therapeutic agent, such as an anti-complement component C5 antibody, or antigen-binding fragment thereof (e.g., eculizumab), an iRNA agent targeting complement component C5, and/or a C3 peptide inhibitor (e.g., compstatin), for preventing at least one symptom in a subject suffering from a disorder that would benefit from a reduction and/or inhibition of C3 expression, such as a complement component C3-associated disease, e.g., paroxysmal nocturnal hemoglobinuria (PNH), atypical hemolytic uremic syndrome (aHUS), atypical hemolytic uremic syndrome (aHUS), neuromyelitis optica (NMO), multifocal motor neuropathy (MMN), myasthenia gravis (MG), C3 glomerulonephritis, or systemic lupus erythematosis.

In a further aspect, the present invention provides uses of an iRNA agent of the invention in the manufacture of a medicament for use in combination with an additional therapeutic agent, such as an anti-complement component C5 antibody, or antigen-binding fragment thereof (e.g., eculizumab), an iRNA agent targeting complement component C5, and/or a C3 peptide inhibitor (e.g., compstatin), for preventing at least one symptom in a subject suffering from a disorder that would benefit from a reduction and/or inhibition of C3 expression, such as a complement component C3-associated disease, e.g., paroxysmal nocturnal hemoglobinuria (PNH), atypical hemolytic uremic syndrome (aHUS), atypical hemolytic uremic syndrome (aHUS), neuromyelitis optica (NMO), multifocal motor neuropathy (MMN), myasthenia gravis (MG), C3 glomerulonephritis, or systemic lupus erythematosis.

In one embodiment, an iRNA agent targeting C3 is administered to a subject having a complement component C3-associated disease as described herein such that C3 levels, e.g., in a cell, tissue, blood, urine or other tissue or fluid of the subject are reduced by at least about 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 62%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or at least about 99% or more and, subsequently, an additional therapeutic is administered to the subject.

The additional therapeutic may be an anti-complement component C5 antibody, or antigen-binding fragment or derivative thereof. In one embodiment, the anti-complement component C5 antibody is eculizumab (SOLIRIS®), or antigen-binding fragment or derivative thereof.

The methods of the invention comprising administration of an iRNA agent of the invention and eculizumab to a subject may further comprise administration of a meningococcal vaccine to the subject.

The additional therapeutic, e.g., eculizumab and/or a meningococcal vaccine, may be administered to the subject at the same time as the iRNA agent targeting C3 (and/or C5) or at a different time.

Moreover, the additional therapeutic, e.g., eculizumab, may be administered to the subject in the same formulation as the iRNA agent targeting C3 (and/or C5) or in a different formulation as the iRNA agent targeting C3 (and/or C5).

Eculizumab dosage regimens are described in, for example, the product insert for eculizumab (SOLIRIS®) and in U.S. Patent Application No. 2012/0225056, the entire contents of each of which are incorporated herein by reference. In exemplary methods of the invention for treating a complement component C3-associated disease, e.g., PNH, aHUS, rheumatoid arthritis, or systemic lupus erythmatosis, an iRNA agent targeting, e.g., C3, is administered (e.g., subcutaneously) to the subject first, such that the C5 levels in the subject are reduced (e.g., by at least about 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 62%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or at least about 99% or more) and subsequently eculizumab is administered at doses lower than the ones described in the product insert for SOLIRIS®. For example, eculizumab may be administered to the subject weekly at a dose less than about 600 mg for 4 weeks followed by a fifth dose at about one week later of less than about 900 mg, followed by a dose less than about 900 mg about every two weeks thereafter. Eculizumab may also be administered to the subject weekly at a dose less than about 900 mg for 4 weeks followed by a fifth dose at about one week later of less than about 1200 mg, followed by a dose less than about 1200 mg about every two weeks thereafter. If the subject is less than 18 years of age, eculizumab may be administered to the subject weekly at a dose less than about 900 mg for 4 weeks followed by a fifth dose at about one week later of less than about 1200 mg, followed by a dose less than about 1200 mg about every two weeks thereafter; or if the subject is less than 18 years of age, eculizumab may be administered to the subject weekly at a dose less than about 600 mg for 2 weeks followed by a third dose at about one week later of less than about 900 mg, followed by a dose less than about 900 mg about every two weeks thereafter; or if the subject is less than 18 years of age, eculizumab may be administered to the subject weekly at a dose less than about 600 mg for 2 weeks followed by a third dose at about one week later of less than about 600 mg, followed by a dose less than about 600 mg about every two weeks thereafter; or if the subject is less than 18 years of age, eculizumab may be administered to the subject weekly at a dose less than about 600 mg for 1 week followed by a second dose at about one week later of less than about 300 mg, followed by a dose less than about 300 mg about every two weeks thereafter; or if the subject is less than 18 years of age, eculizumab may be administered to the subject weekly at a dose less than about 300 mg for 1 week followed by a second dose at about one week later of less than about 300 mg, followed by a dose less than about 300 mg about every two weeks thereafter. If the subject is receiving plamapheresis or plasma exchange, eculizumab may be administered to the subject at a dose less than about 300 mg (e.g., if the most recent does of eculizumab was about 300 mg) or less than about 600 mg (e.g., if the most recent does of eculizumab was about 600 mg or more). If the subject is receiving plasma infusion, eculizumab may be administered to the subject at a dose less than about 300 mg (e.g., if the most recent does of eculizumab was about 300 mg or more). The lower doses of eculizumab allow for either subcutaneous or intravenous administration of eculizumab.

In the combination therapies of the present invention comprising eculizumab, eculizumab may be administered to the subject, e.g., subcutaneously, at a dose of about 0.01 mg/kg to about 10 mg/kg, or about 5 mg/kg to about 10 mg/kg, or about 0.5 mg/kg to about 15 mg/kg. For example, eculizumab may be administered to the subject, e.g., subcutaneously, at a dose of 0.5 mg/kg, 1 mg/kg, 1.5 mg/kg, 2 mg/kg, 2.5 mg/kg, 3 mg/kg, 3.5 mg/kg, 4 mg/kg, 4.5 mg/kg, 5 mg/kg, 5.5 mg/kg, 6 mg/kg, 6.5 mg/kg, 7 mg/kg, 7.5 mg/kg, 8 mg/kg, 8.5 mg/kg, 9 mg/kg, 9.5 mg/kg, 10 mg/kg, 10.5 mg/kg, 11 mg/kg, 11.5 mg/kg, 12 mg/kg, 12.5 mg/kg, 13 mg/kg, 13.5 mg/kg, 14 mg/kg, 14.5 mg/kg, or 15 mg/kg.

The methods and uses of the invention include administering a composition described herein such that expression of the target C3 (and/or C5) gene is decreased, such as for about 1, 2, 3, 4, 5, 6, 7, 8, 12, 16, 18, 24, 28, 32, 36, 40, 44, 48, 52, 56, 60, 64, 68, 72, 76, or about 80 hours. In one embodiment, expression of the target gene is decreased for an extended duration, e.g., at least about two, three, four, five, six, seven days or more, e.g., about one week, two weeks, three weeks, or about four weeks or longer.

The present invention also provides methods of using an iRNA agent of the invention and/or a composition containing an iRNA agent of the invention to reduce and/or inhibit C3 expression in a subject.

In other aspects, use of an iRNA of the invention and/or a composition comprising an iRNA of the invention for the manufacture of a medicament for reducing and/or inhibiting C3 gene expression in a subject are provided.

Reduction in gene expression can be assessed by any methods known in the art. For example, a reduction in the expression of C3 may be determined by determining the mRNA expression level of C3 using methods routine to one of ordinary skill in the art, e.g., Northern blotting, qRT-PCR, by determining the protein level of C3 using methods routine to one of ordinary skill in the art, such as Western blotting, immunological techniques, flow cytometry methods, ELISA, and/or by determining a biological activity of C3.

C3 gene expression may be inhibited in the cell by at least about 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or about 100%, or below the level of detection of the assay method used.

C3 protein production may be inhibited in the cell by at least about 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or about 100%, or below the level of detection of the assay method used.

The in vivo methods and uses of the invention may include administering to a subject a composition containing an iRNA, where the iRNA includes a nucleotide sequence that is complementary to at least a part of an RNA transcript of the C3 gene of the mammal to be treated. When the organism to be treated is a human, the composition can be administered by any means known in the art including, but not limited to subcutaneous, intravenous, oral, intraperitoneal, or parenteral routes, including intracranial (e.g., intraventricular, intraparenchymal and intrathecal), intramuscular, transdermal, airway (aerosol), nasal, rectal, and topical (including buccal and sublingual) administration. In certain embodiments, the compositions are administered by subcutaneous or intravenous infusion or injection. In one embodiment, the compositions are administered by subcutaneous injection. In some embodiments, the compositions are administered by intravenous infusion.

In some embodiments, the administration is via a depot injection. A depot injection may release the iRNA in a consistent way over a prolonged time period. Thus, a depot injection may reduce the frequency of dosing needed to obtain a desired effect, e.g., a desired inhibition of C3, or a therapeutic or prophylactic effect. A depot injection may also provide more consistent serum concentrations. Depot injections may include subcutaneous injections or intramuscular injections. In preferred embodiments, the depot injection is a subcutaneous injection.

In some embodiments, the administration is via a pump. The pump may be an external pump or a surgically implanted pump. In certain embodiments, the pump is a subcutaneously implanted osmotic pump. In other embodiments, the pump is an infusion pump. An infusion pump may be used for intravenous, subcutaneous, arterial, or epidural infusions. In preferred embodiments, the infusion pump is a subcutaneous infusion pump. In other embodiments, the pump is a surgically implanted pump that delivers the iRNA to the subject.

The mode of administration may be chosen based upon whether local or systemic treatment is desired and based upon the area to be treated. The route and site of administration may be chosen to enhance targeting.

In one aspect, the present invention also provides methods for inhibiting the expression of a C3 gene in a mammal, e.g., a human. The present invention also provides a composition comprising an iRNA, e.g., a dsRNA, that targets a C3 gene in a cell of a mammal for use in inhibiting expression of the C3 gene in the mammal. In another aspect, the present invention provides use of an iRNA, e.g., a dsRNA, that targets a C3 gene in a cell of a mammal in the manufacture of a medicament for inhibiting expression of the C3 gene in the mammal.

The methods and uses include administering to the mammal, e.g., a human, a composition comprising an iRNA, e.g., a dsRNA, that targets a C3 gene in a cell of the mammal and maintaining the mammal for a time sufficient to obtain degradation of the mRNA transcript of the C3 gene, thereby inhibiting expression of the C3 gene in the mammal.

In one embodiment, verification of RISC medicated cleavage of target in vivo following administration of iRNA agent is done by performing 5'-RACE or modifications of the protocol as known in the art (Lasham A et al., (2010) *Nucleic Acid Res.*, 38 (3) p-e19) (Zimmermann et al. (2006) *Nature* 441: 111-4).

Unless otherwise defined, all technical and scientific terms used herein have the same meaning as commonly understood by one of ordinary skill in the art to which this invention belongs. Although methods and materials similar or equivalent to those described herein can be used in the practice or testing of the iRNAs and methods featured in the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

Example 1. iRNA Synthesis

Source of Reagents

Where the source of a reagent is not specifically given herein, such reagent can be obtained from any supplier of reagents for molecular biology at a quality/purity standard for application in molecular biology.

Transcripts

A set of siRNAs targeting human C3 (human NCBI refseqID: NM_000064; NCBI GeneID: 718) were designed using custom R and Python scripts. The human C3 REFSEQ mRNA has a length of 5148 bases.

A detailed list of the unmodified C3 sense and antisense strand sequences is shown in Tables 3 and 6. A detailed list of the modified C3 sense and antisense strand sequences is shown in Tables 4 and 7.

Example 2. In Vitro Screening

Cell Culture and Transfections

Hep3b cells were transfected by adding 4.9 µl of Opti-MEM plus 0.1 µl of Lipofectamine RNAiMax per well (Invitrogen, Carlsbad Calif. cat #13778-150) to 5 µl of siRNA duplexes per well into a 384-well plate and incubated at room temperature for 15 minutes. Forty µl of EMEM containing $5 \times 10^3$ cells were then added to the siRNA mixture. Cells were incubated for 24 hours prior to RNA purification. Single dose experiments were performed at 10 nM final duplex concentration.

Total RNA Isolation Using DYNABEADS mRNA Isolation Kit:

RNA was isolated using an automated protocol on a BioTek-EL406 platform using DYNABEADs (Invitrogen, cat #61012). Briefly, 50 µl of Lysis/Binding Buffer and 25 µl of lysis buffer containing 3 µl of magnetic beads were added to the plate with cells. Plates were incubated on an electromagnetic shaker for 10 minutes at room temperature and then magnetic beads were captured and the supernatant was removed. Bead-bound RNA was then washed 2 times with 150 µl Wash Buffer A and once with Wash Buffer B. Beads were then washed with 150 µl Elution Buffer, re-captured and supernatant removed.

cDNA Synthesis Using ABI High Capacity cDNA Reverse Transcription Kit (Applied Biosystems, Foster City, Calif., Cat #4368813):

Ten µl of a master mix containing 1 µl 10× Buffer, 0.4 µl 25×dNTPs, 1 µl 10× Random primers, 0.5 µl Reverse Transcriptase, 0.5 µl RNase inhibitor and 6.6 µl of H₂O per reaction was added to RNA isolated above. Plates were sealed, mixed, and incubated on an electromagnetic shaker for 10 minutes at room temperature, followed by 2 hours 37° C.

Real Time PCR

Two μl of cDNA were added to a master mix containing 0.5 μl of GAPDH TaqMan Probe (Hs99999905), 0.5 μl C3 (Hs00163811_m1) and 5 μl Lightcycler 480 probe master mix (Roche Cat #04887301001) per well in a 384 well plates (Roche cat #04887301001). Real time PCR was done in a LightCycler480 Real Time PCR system (Roche) using the ΔΔCt(RQ) assay. Each duplex was tested in four independent transfections.

To calculate relative fold change, real time data were analyzed using the ΔΔCt method and normalized to assays performed with cells transfected with 20 nM AD-1955, or mock transfected cells.

Tables 5 and 8 shows the results of a single dose screen in Hep3B cells transfected with the indicated C3 iRNAs. Data are expressed as percent of message remaining relative to untreated cells.

TABLE 2

Abbreviations of nucleotide monomers used in nucleic acid sequence representation. It will be understood that these monomers, when present in an oligonucleotide, are mutually linked by 5'-3'-phosphodiester bonds.

| Abbreviation | Nucleotide(s) |
|---|---|
| A | Adenosine-3'-phosphate |
| Af | 2'-fluoroadenosine-3'-phosphate |
| Afs | 2'-fluoroadenosine-3'-phosphorothioate |
| As | adenosine-3'-phosphorothioate |
| C | cytidine-3'-phosphate |
| Cf | 2'-fluorocytidine-3'-phosphate |
| Cfs | 2'-fluorocytidine-3'-phosphorothioate |

TABLE 2-continued

Abbreviations of nucleotide monomers used in nucleic acid sequence representation. It will be understood that these monomers, when present in an oligonucleotide, are mutually linked by 5'-3'-phosphodiester bonds.

| Abbreviation | Nucleotide(s) |
|---|---|
| Cs | cytidine-3'-phosphorothioate |
| G | guanosine-3'-phosphate |
| Gf | 2'-fluoroguanosine-3'-phosphate |
| Gfs | 2'-fluoroguanosine-3'-phosphorothioate |
| Gs | guanosine-3'-phosphorothioate |
| T | 5'-methyluridine-3'-phosphate |
| Tf | 2'-fluoro-5-methyluridine-3'-phosphate |
| Tfs | 2'-fluoro-5-methyluridine-3'-phosphorothioate |
| Ts | 5-methyluridine-3'-phosphorothioate |
| U | Uridine-3'-phosphate |
| Uf | 2'-fluorouridine-3'-phosphate |
| Ufs | 2'-fluorouridine-3'-phosphorothioate |
| Us | uridine-3'-phosphorothioate |
| N | any nucleotide (G, A, C, T or U) |
| a | 2'-O-methyladenosine-3'-phosphate |
| as | 2'-O-methyladenosine-3'-phosphorothioate |
| c | 2'-O-methylcytidine-3'-phosphate |
| cs | 2'-O-methylcytidine-3'-phosphorothioate |
| g | 2'-O-methylguanosine-3'-phosphate |
| gs | 2'-O-methylguanosine-3'-phosphorothioate |
| t | 2'-O-methyl-5-methyluridine-3'-phosphate |
| ts | 2'-O-methyl-5-methyluridine-3'-phosphorothioate |
| u | 2'-O-methyluridine-3'-phosphate |
| us | 2'-O-methyluridine-3'-phosphorothioate |
| s | phosphorothioate linkage |
| L96 | N-[tris(GalNAc-alkyl)-amidodecanoyl)]-4-hydroxyprolinol Hyp-(GalNAc-alkyl)3 |

TABLE 3

Complement Component C3 unmodified sequences

| Duplex Name | Sense Sequence 5' to 3' | SEQ ID NO: | Range in NM_000064.3 | Antisense Sequence 5' to 3' | SEQ ID NO: |
|---|---|---|---|---|---|
| AD-76619 | UCACUCCUCCCCAUCCUCU | 9 | 31-49 | AGAGGAUGGGGAGGAGUGA | 277 |
| AD-76864 | UCUGUCCCUCUGUCCCUCU | 10 | 53-71 | AGAGGGACAGAGGGACAGA | 278 |
| AD-76867 | CAGCACCAUGGGACCCACA | 11 | 87-105 | UGUGGGUCCCAUGGUGCUG | 279 |
| AD-76667 | CCUCAGGUCCCAGCCUGCU | 12 | 104-122 | AGCAGGCUGGGACCUGAGG | 280 |
| AD-76602 | CCAGCCUGCUGCUCCUGCU | 13 | 113-131 | AGCAGGAGCAGCAGGCUGG | 281 |
| AD-76892 | UACUAACCCACCUCCCCCU | 14 | 131-149 | AGGGGGAGGUGGGUUAGUA | 282 |
| AD-76665 | UACUCUAUCAUCACCCCCA | 15 | 169-187 | UGGGGGUGAUGAUAGAGUA | 283 |
| AD-76900 | CAACAUCUUGCGGCUGGAA | 16 | 186-204 | UUCCAGCCGCAAGAUGUUG | 284 |
| AD-76868 | AGAGCGAGGAGACCAUGGU | 17 | 203-221 | ACCAUGGUCUCCUCGCUCU | 285 |
| AD-76671 | UUCCAGUCACUGUUACUGU | 18 | 251-269 | ACAGUAACAGUGACUGGAA | 286 |
| AD-76564 | UUCCCAGGCAAAAAACUAA | 19 | 277-295 | UUAGUUUUUGCCUGGGAA | 287 |
| AD-76600 | AGUGCUGUCCAGUGAGAAA | 20 | 294-312 | UUUCUCACUGGACAGCACU | 288 |
| AD-76676 | AGACUGUGCUGACCCCUGA | 21 | 311-329 | UCAGGGGUCAGCACAGUCU | 289 |
| AD-76915 | CAGGGAGUUCAAGUCAGAA | 22 | 372-390 | UUCUGACUUGAACUCCCUG | 290 |
| AD-76577 | UUCAAGUCAGAAAAGGGGA | 23 | 379-397 | UCCCCUUUUCUGACUUGAA | 291 |
| AD-76560 | UUCGUGACCGUGCAGGCCA | 24 | 406-424 | UGGCCUGCACGGUCACGAA | 292 |
| AD-76664 | CAGGCCACCUUCGGGACCA | 25 | 418-436 | UGGUCCCGAAGGUGGCCUG | 293 |
| AD-76889 | CAAGUGGUGGAGAAGGUGA | 26 | 436-454 | UCACCUUCUCCACCACUUG | 294 |

TABLE 3-continued

Complement Component C3 unmodified sequences

| Duplex Name | Sense Sequence 5' to 3' | SEQ ID NO: | Range in NM_000064.3 | Antisense Sequence 5' to 3' | SEQ ID NO: |
|---|---|---|---|---|---|
| AD-76718 | GUGCUGGUCAGCCUGCAGA | 27 | 454-472 | UCUGCAGGCUGACCAGCAC | 295 |
| AD-76606 | AGCGGGUACCUCUUCAUCA | 28 | 472-490 | UGAUGAAGAGGUACCCGCU | 296 |
| AD-76685 | CAGACAGACAAGACCAUCU | 29 | 490-508 | AGAUGGUCUUGUCUGUCUG | 297 |
| AD-76599 | CUACACCCCUGGCUCCACA | 30 | 507-525 | UGUGGAGCCAGGGGUGUAG | 298 |
| AD-76678 | ACAGUUCUCUAUCGGAUCU | 31 | 523-541 | AGAUCCGAUAGAGAACUGU | 299 |
| AD-76670 | UUCACCGUCAACCACAAGA | 32 | 541-559 | UCUUGUGGUUGACGGUGAA | 300 |
| AD-76609 | GGACGGUCAUGGUCAACAU | 33 | 575-593 | AUGUUGACCAUGACCGUCC | 301 |
| AD-76616 | UUGAGAACCCGGAAGGCAU | 34 | 593-611 | AUGCCUUCCGGGUUCUCAA | 302 |
| AD-76629 | AUCCCGGUCAAGCAGGACU | 35 | 610-628 | AGUCCUGCUUGACCGGGAU | 303 |
| AD-76850 | CUCCUUGUCUUCUCAGAAA | 36 | 627-645 | UUUCUGAGAAGACAAGGAG | 304 |
| AD-76847 | UUGUCUUCUCAGAACCAGA | 37 | 631-649 | UCUGGUUCUGAGAAGACAA | 305 |
| AD-76668 | GCUUGGCGUCUUGCCCUUA | 38 | 648-666 | UAAGGGCAAGACGCCAAGC | 306 |
| AD-76920 | UGCCCUUGUCUUGGGACAU | 39 | 659-677 | AUGUCCCAAGACAAGGGCA | 307 |
| AD-76637 | AUGGGCCAGUGGAAGAUCA | 40 | 694-712 | UGAUCUUCCACUGGCCCAU | 308 |
| AD-76627 | GCCAGUGGAAGAUCCGAGA | 41 | 698-716 | UCUCGGAUCUUCCACUGGC | 309 |
| AD-76708 | CCUACUAUGAAAACUCACA | 42 | 716-734 | UGUGAGUUUUCAUAGUAGG | 310 |
| AD-76594 | CACUGAGUUUGAGGUGAAA | 43 | 750-768 | UUUCACCUCAAACUCAGUG | 311 |
| AD-76858 | UUUGAGGUGAAGGAGUACA | 44 | 757-775 | UGUACUCCUUCACCUCAAA | 312 |
| AD-76731 | CGUGCUGCCCAGUUUCGAA | 45 | 774-792 | UUCGAAACUGGGCAGCACG | 313 |
| AD-76660 | AGGUCAUAGUGGAGCCUAA | 46 | 791-809 | UUAGGCUCCACUAUGACCU | 314 |
| AD-76729 | CAGAGAAAUUCUACUACAU | 47 | 809-827 | AUGUAGUAGAAUUUCUCUG | 315 |
| AD-76657 | UCUAUAACGAGAAGGGCCU | 48 | 827-845 | AGGCCCUUCUCGUUAUAGA | 316 |
| AD-76882 | CUGGAGGUCACCAUCACCA | 49 | 844-862 | UGGUGAUGGUGACCUCCAG | 317 |
| AD-76674 | GCCAGGUUCCUCUACGGGA | 50 | 862-880 | UCCCGUAGAGGAACCUGGC | 318 |
| AD-76581 | AAGAAAGUGGAGGGAACUA | 51 | 880-898 | UAGUUCCCUCCACUUUCUU | 319 |
| AD-76684 | GGAACUGCCUUUGUCAUCU | 52 | 892-910 | AGAUGACAAAGGCAGUUCC | 320 |
| AD-76633 | UUCGGGAUCCAGGAUGGCA | 53 | 910-928 | UGCCAUCCUGGAUCCCGAA | 321 |
| AD-76902 | CGAACAGAGGAUUUCCCUA | 54 | 927-945 | UAGGGAAAUCCUCUGUUCG | 322 |
| AD-76921 | UUUCCCUGCCUGAAUCCCU | 55 | 938-956 | AGGGAUUCAGGCAGGGAAA | 323 |
| AD-76691 | CUCAAGCGCAUUCCGAUUA | 56 | 955-973 | UAAUCGGAAUGCGCUUGAG | 324 |
| AD-76592 | UGAGGAUGGCUCGGGGAA | 57 | 972-990 | UUCCCCGAGCCAUCCUCA | 325 |
| AD-76642 | AGGUUGUGCUGAGCCGGAA | 58 | 989-1007 | UUCCGGCUCAGCACAACCU | 326 |
| AD-76869 | UGCUGAGCCGGAAGGUACU | 59 | 995-1013 | AGUACCUUCCGGCUCAGCA | 327 |
| AD-76716 | GGUACUGCUGGACGGGGUA | 60 | 1008-1026 | UACCCCGUCCAGCAGUACC | 328 |
| AD-76689 | GCAGAACCCCGAGCAGAA | 61 | 1026-1044 | UUCUGCUCGGGGUUCUGC | 329 |
| AD-76679 | UACGUGUCUGCCACCGUCA | 62 | 1066-1084 | UGACGGUGGCAGACACGUA | 330 |
| AD-76563 | UUGCACUCAGGCAGUGACA | 63 | 1087-1105 | UGUCACUGCCUGAGUGCAA | 331 |

TABLE 3-continued

Complement Component C3 unmodified sequences

| Duplex Name | Sense Sequence 5' to 3' | SEQ ID NO: | Range in NM_000064.3 | Antisense Sequence 5' to 3' | SEQ ID NO: |
|---|---|---|---|---|---|
| AD-76568 | AGGCAGAGCGCAGCGGGAU | 64 | 1112-1130 | AUCCCGCUGCGCUCUGCCU | 332 |
| AD-76574 | UUCACCAAGACACCCAAGU | 65 | 1162-1180 | ACUUGGGUGUCUUGGUGAA | 333 |
| AD-76875 | ACCAAGACACCCAAGUACU | 66 | 1165-1183 | AGUACUUGGGUGUCUUGGU | 334 |
| AD-76677 | UUCAAACCAGGAAUGCCCU | 67 | 1183-1201 | AGGGCAUUCCUGGUUUGAA | 335 |
| AD-76861 | UCGUGACGAACCCUGAUGA | 68 | 1217-1235 | UCAUCAGGGUUCGUCACGA | 336 |
| AD-76672 | UCCAGGGCGAGGACACUGU | 69 | 1265-1283 | ACAGUGUCCUCGCCCUGGA | 337 |
| AD-76908 | GAGGACACUGUGCAGUCUA | 70 | 1273-1291 | UAGACUGCACAGUGUCCUC | 338 |
| AD-76625 | CUAACCCAGGGAGAUGGCA | 71 | 1291-1309 | UGCCAUCUCCCUGGGUUAG | 339 |
| AD-76571 | CGUGGCCAAACUCAGCAUA | 72 | 1308-1326 | UAUGCUGAGUUUGGCCACG | 340 |
| AD-76580 | UCAACACACACCCCAGCCA | 73 | 1325-1343 | UGGCUGGGGUGUGUGUUGA | 341 |
| AD-76673 | CAGAAGCCCUUGAGCAUCA | 74 | 1342-1360 | UGAUGCUCAAGGGCUUCUG | 342 |
| AD-76641 | UUGAGCAUCACGGUGCGCA | 75 | 1351-1369 | UGCGCACCGUGAUGCUCAA | 343 |
| AD-76695 | GAGCUCUCGGAGGCAGAGA | 76 | 1381-1399 | UCUCUGCCUCCGAGAGCUC | 344 |
| AD-76666 | CAGGCUACCAGGACCAUGA | 77 | 1399-1417 | UCAUGGUCCUGGUAGCCUG | 345 |
| AD-76853 | GCAGGCUCUGCCCUACAGA | 78 | 1416-1434 | UCUGUAGGGCAGAGCCUGC | 346 |
| AD-76639 | UACAGCACCGUGGGCAACU | 79 | 1429-1447 | AGUUGCCCACGGUGCUGUA | 347 |
| AD-76872 | CUCCAACAAUUACCUGCAU | 80 | 1446-1464 | AUGCAGGUAAUUGUUGGAG | 348 |
| AD-76680 | CAGUGCUACGUACAGAGCU | 81 | 1469-1487 | AGCUCUGUACGUAGCACUG | 349 |
| AD-76709 | UCAGACCCGGGGAGACCCU | 82 | 1487-1505 | AGGGUCUCCCCGGGUCUGA | 350 |
| AD-76860 | GCGCCCACGAGGCCAAGAU | 83 | 1535-1553 | AUCUUGGCCUCGUGGGCGC | 351 |
| AD-76610 | UCCGCUACUACACCUACCU | 84 | 1553-1571 | AGGUAGGUGUAGUAGCGGA | 352 |
| AD-76608 | CUGAUCAUGAACAAGGGCA | 85 | 1570-1588 | UGCCCUUGUUCAUGAUCAG | 353 |
| AD-76662 | CAGGCUGUUGAAGGCGGGA | 86 | 1587-1605 | UCCCGCCUUCAACAGCCUG | 354 |
| AD-76899 | GACGCCAGGUGCGAGAGCA | 87 | 1604-1622 | UGCUCUCGCACCUGGCGUC | 355 |
| AD-76640 | CCCGGCCAGGACCUGGUGA | 88 | 1621-1639 | UCACCAGGUCCUGGCCGGG | 356 |
| AD-76705 | UUCCGCCUGGUGGCGUACU | 89 | 1678-1696 | AGUACGCCACCAGGCGGAA | 357 |
| AD-76866 | CUACACGCUGAUCGGUGCA | 90 | 1695-1713 | UGCACCGAUCAGCGUGUAG | 358 |
| AD-76652 | UGGGUGGACGUCAAGGACU | 91 | 1747-1765 | AGUCCUUGACGUCCACCCA | 359 |
| AD-76838 | CCUGCGUGGGCUCGCUGGU | 92 | 1766-1784 | ACCAGCGAGCCCACGCAGG | 360 |
| AD-76636 | UGGUAAAAAGCGGCCAGUA | 93 | 1784-1802 | UACUGGCCGCUUUUUACCA | 361 |
| AD-76848 | CAGAAGACCGGCAGCCUGU | 94 | 1802-1820 | ACAGGCUGCCGGUCUUCUG | 362 |
| AD-76655 | CCUGGGCAGCAGAUGACCA | 95 | 1822-1840 | UGGUCAUCUGCUGCCCAGG | 363 |
| AD-76700 | CUGAAGAUAGAGGGUGACA | 96 | 1840-1858 | UGUCACCCUCUAUCUUCAG | 364 |
| AD-76583 | CCACGGGGCCCGGUGGUA | 97 | 1857-1875 | UACCACCGGGCCCCGUGG | 365 |
| AD-76919 | ACUGGUGGCCGUGGACAAA | 98 | 1875-1893 | UUUGUCCACGGCCACCAGU | 366 |
| AD-76681 | UAAGAAGAACAAACUGACA | 99 | 1911-1929 | UGUCAGUUUGUUCUUCUUA | 367 |
| AD-76724 | CGCAGAGUAAGAUCUGGGA | 100 | 1928-1946 | UCCCAGAUCUUACUCUGCG | 368 |
| AD-76696 | GACGUGGUGGAGAAGGCAA | 101 | 1945-1963 | UUGCCUUCUCCACCACGUC | 369 |

TABLE 3-continued

Complement Component C3 unmodified sequences

| Duplex Name | Sense Sequence 5' to 3' | SEQ ID NO: | Range in NM_000064.3 | Antisense Sequence 5' to 3' | SEQ ID NO: |
|---|---|---|---|---|---|
| AD-76890 | ACCCCGGGCAGUGGGAAGA | 102 | 1975-1993 | UCUUCCCACUGCCCGGGGU | 370 |
| AD-76638 | GAUUACGCCGGUGUCUUCU | 103 | 1993-2011 | AGAAGACACCGGCGUAAUC | 371 |
| AD-76883 | UCCGACGCAGGGCUGACCU | 104 | 2011-2029 | AGGUCAGCCCUGCGUCGGA | 372 |
| AD-76839 | UUCACGAGCAGCAGUGGCA | 105 | 2029-2047 | UGCCACUGCUGCUCGUGAA | 373 |
| AD-76590 | CCAGCAGACCGCCCAGAGA | 106 | 2046-2064 | UCUCUGGGCGGUCUGCUGG | 374 |
| AD-76721 | CCGCCCAGAGGGCAGAACU | 107 | 2054-2072 | AGUUCUGCCCUCUGGGCGG | 375 |
| AD-76646 | UUCAGUGCCCGCAGCCAGA | 108 | 2072-2090 | UCUGGCUGCGGGCACUGAA | 376 |
| AD-76605 | GCCGCCCGCCGACGCCGUU | 109 | 2089-2107 | AACGGCGUCGGCGGGCGGC | 377 |
| AD-76719 | ACGGAGAAGCGAAUGGACA | 110 | 2119-2137 | UGUCCAUUCGCUUCUCCGU | 378 |
| AD-76624 | AAAGUCGGCAAGUACCCCA | 111 | 2137-2155 | UGGGGUACUUGCCGACUUU | 379 |
| AD-76626 | CAAGGAGCUGCGCAAGUGA | 112 | 2154-2172 | UCACUUGCGCAGCUCCUUG | 380 |
| AD-76603 | GCUGCGAGGACGGCAUGCA | 113 | 2171-2189 | UGCAUGCCGUCCUCGCAGC | 381 |
| AD-76846 | CCAUGAGGUUCUCGUGCCA | 114 | 2198-2216 | UGGCACGAGAACCUCAUGG | 382 |
| AD-76635 | UUCUCGUGCCAGCGCCGGA | 115 | 2206-2224 | UCCGGCGCUGGCACGAGAA | 383 |
| AD-76893 | CGUUUCAUCUCCCUGGGCA | 116 | 2227-2245 | UGCCCAGGGAGAUGAAACG | 384 |
| AD-76923 | GAGGCGUGCAAGAAGGUCU | 117 | 2245-2263 | AGACCUUCUUGCACGCCUC | 385 |
| AD-76736 | UUCCUGGACUGCUGCAACU | 118 | 2263-2281 | AGUUGCAGCAGUCCAGGAA | 386 |
| AD-76566 | CUACAUCACAGAGCUGCGA | 119 | 2280-2298 | UCGCAGCUCUGUGAUGUAG | 387 |
| AD-76656 | ACGCGCGGGCCAGCCACCU | 120 | 2306-2324 | AGGUGGCUGGCCCGCGCGU | 388 |
| AD-76596 | UGGGCCUGGCCAGGAGUAA | 121 | 2324-2342 | UUACUCCUGGCCAGGCCCA | 389 |
| AD-76562 | ACCUGGAUGAGGACAUCAU | 122 | 2342-2360 | AUGAUGUCCUCAUCCAGGU | 390 |
| AD-76607 | UUGCAGAAGAGAACAUCGU | 123 | 2360-2378 | ACGAUGUUCUCUUCUGCAA | 391 |
| AD-76702 | GUUUCCCGAAGUGAGUUCA | 124 | 2377-2395 | UGAACUCACUUCGGGAAAC | 392 |
| AD-76879 | UUCCCAGAGAGCUGGCUGU | 125 | 2392-2410 | ACAGCCAGCUCUCUGGGAA | 393 |
| AD-76663 | GUGGAACGUUGAGGACUUA | 126 | 2409-2427 | UAAGUCCUCAACGUUCCAC | 394 |
| AD-76913 | UUGAGGACUUGAAAGAGCA | 127 | 2417-2435 | UGCUCUUUCAAGUCCUCAA | 395 |
| AD-76909 | AGGACUUGAAAGAGCCACA | 128 | 2420-2438 | UGUGGCUCUUUCAAGUCCU | 396 |
| AD-76843 | CGAAAAUGGAAUCUCUAA | 129 | 2438-2456 | UUAGAGAUUCCAUUUUUCG | 397 |
| AD-76597 | CUCUACGAAGCUCAUGAAU | 130 | 2451-2469 | AUUCAUGAGCUUCGUAGAG | 398 |
| AD-76732 | UAUAUUUUGAAAGACUCA | 131 | 2469-2487 | UGAGUCUUUCAAAAAUAUA | 399 |
| AD-76871 | CCAUCACCACGUGGGAGAU | 132 | 2486-2504 | AUCUCCCACGUGGUGAUGG | 400 |
| AD-76643 | AUUCUGGCUGUGAGCAUGU | 133 | 2503-2521 | ACAUGCUCACAGCCAGAAU | 401 |
| AD-76621 | UCGGACAAGAAAGGGAUCU | 134 | 2521-2539 | AGAUCCCUUUCUUGUCCGA | 402 |
| AD-76884 | GCAGACCCCUUCGAGGUCA | 135 | 2545-2563 | UGACCUCGAAGGGGUCUGC | 403 |
| AD-76570 | UUCAUCGACCUGCGGCUAA | 136 | 2581-2599 | UUAGCCGCAGGUCGAUGAA | 404 |
| AD-76612 | ACCCUACUCUGUUGUUCGA | 137 | 2598-2616 | UCGAACAACAGAGUAGGGU | 405 |
| AD-76582 | CUGUUGUUCGAAACGAGCA | 138 | 2606-2624 | UGCUCGUUUCGAACAACAG | 406 |

TABLE 3-continued

Complement Component C3 unmodified sequences

| Duplex Name | Sense Sequence 5' to 3' | SEQ ID NO: | Range in NM_000064.3 | Antisense Sequence 5' to 3' | SEQ ID NO: |
|---|---|---|---|---|---|
| AD-76841 | CAGGUGGAAAUCCGAGCCA | 139 | 2623-2641 | UGGCUCGGAUUUCCACCUG | 407 |
| AD-76620 | CGUUCUCUACAAUUACCGA | 140 | 2640-2658 | UCGGUAAUUGUAGAGAACG | 408 |
| AD-76694 | AAGAGCUCAAGGUGAGGGU | 141 | 2666-2684 | ACCCUCACCUUGAGCUCUU | 409 |
| AD-76632 | GUGGAACUACUCCACAAUA | 142 | 2683-2701 | UAUUGUGGAGUAGUUCCAC | 410 |
| AD-76591 | UACUCCACAAUCCAGCCUU | 143 | 2690-2708 | AAGGCUGGAUUGUGGAGUA | 411 |
| AD-76593 | UUCUGCAGCCUGGCCACCA | 144 | 2707-2725 | UGGUGGCCAGGCUGCAGAA | 412 |
| AD-76713 | CACCAAGAGGCGUCACCAA | 145 | 2724-2742 | UUGGUGACGCCUCUUGGUG | 413 |
| AD-76726 | AGCAGACCGUAACCAUCCA | 146 | 2741-2759 | UGGAUGGUUACGGUCUGCU | 414 |
| AD-76693 | UCCUCGUUGUCCGUUCCAU | 147 | 2767-2785 | AUGGAACGGACAACGAGGA | 415 |
| AD-76876 | UAUGUCAUCGUGCCGCUAA | 148 | 2785-2803 | UUAGCGGCACGAUGACAUA | 416 |
| AD-76589 | AGACCGGCCUGCAGGAAGU | 149 | 2804-2822 | ACUUCCUGCAGGCCGGUCU | 417 |
| AD-76891 | GUGGAAGUCAAGGCUGCUA | 150 | 2821-2839 | UAGCAGCCUUGACUUCCAC | 418 |
| AD-76907 | UUCAUCAGUGACGGUGUCA | 151 | 2851-2869 | UGACACCGUCACUGAUGAA | 419 |
| AD-76613 | CAGGAAGUCCCUGAAGGUA | 152 | 2868-2886 | UACCUUCAGGGACUUCCUG | 420 |
| AD-76572 | AAUCAGAAUGAACAAAACU | 153 | 2898-2916 | AGUUUUGUUCAUUCUGAUU | 421 |
| AD-76873 | CUGUGGCUGUUCGCACCCU | 154 | 2915-2933 | AGGGUGCGAACAGCCACAG | 422 |
| AD-76654 | CUGGAUCCAGAACGCCUGA | 155 | 2932-2950 | UCAGGCGUUCUGGAUCCAG | 423 |
| AD-76578 | AAGGAGUGCAGAAAGAGGA | 156 | 2957-2975 | UCCUCUUUCUGCACUCCUU | 424 |
| AD-76894 | GUGACCAAGUCCCGGACAA | 157 | 2996-3014 | UUGUCCGGGACUUGGUCAC | 425 |
| AD-76897 | CCGAGUCUGAGACCAGAAU | 158 | 3014-3032 | AUUCUGGUCUCAGACUCGG | 426 |
| AD-76628 | UUCUCCUGCAAGGGACCCA | 159 | 3032-3050 | UGGGUCCCUUGCAGGAGAA | 427 |
| AD-76688 | CCAGUGGCCCAGAUGACAA | 160 | 3049-3067 | UUGUCAUCUGGGCCACUGG | 428 |
| AD-76651 | CGUCGACGCGGAACGGCUA | 161 | 3075-3093 | UAGCCGUUCCGCGUCGACG | 429 |
| AD-76692 | CGGGGAACAGAACAUGAUA | 162 | 3123-3141 | UAUCAUGUUCUGUUCCCCG | 430 |
| AD-76588 | UCGGCAUGACGCCCACGGU | 163 | 3140-3158 | ACCGUGGGCGUCAUGCCGA | 431 |
| AD-76916 | UACCUGGAUGAAACGGAGA | 164 | 3172-3190 | UCUCCGUUUCAUCCAGGUA | 432 |
| AD-76918 | UGGAUGAAACGGAGCAGUA | 165 | 3176-3194 | UACUGCUCCGUUUCAUCCA | 433 |
| AD-76698 | GGGAGAAGUUCGGCCUAGA | 166 | 3194-3212 | UCUAGGCCGAACUUCUCCC | 434 |
| AD-76723 | AGAAGCGGCAGGGGGCCUU | 167 | 3212-3230 | AAGGCCCCCUGCCGCUUCU | 435 |
| AD-76735 | UUGGAGCUCAUCAAGAAGA | 168 | 3229-3247 | UCUUCUUGAUGAGCUCCAA | 436 |
| AD-76710 | GAGCUCAUCAAGAAGGGGU | 169 | 3232-3250 | ACCCCUUCUUGAUGAGCUC | 437 |
| AD-76852 | UACCCCAGCAGCUGGCCU | 170 | 3250-3268 | AGGCCAGCUGCUGGGUGUA | 438 |
| AD-76840 | CUUCAGACAACCCAGCUCU | 171 | 3267-3285 | AGAGCUGGGUUGUCUGAAG | 439 |
| AD-76727 | AGCUCUGCCUUUGCGGCCU | 172 | 3280-3298 | AGGCCGCAAAGGCAGAGCU | 440 |
| AD-76573 | UUCGUGAAACGGGCACCCA | 173 | 3298-3316 | UGGGUGCCCGUUUCACGAA | 441 |
| AD-76878 | CAGCACCUGGCUGACCGCA | 174 | 3315-3333 | UGCGGUCAGCCAGGUGCUG | 442 |
| AD-76618 | UACGUGGUCAAGGUCUUCU | 175 | 3334-3352 | AGAAGACCUUGACCACGUA | 443 |
| AD-76730 | CUCUCUGGCUGUCAACCUA | 176 | 3351-3369 | UAGGUUGACAGCCAGAGAG | 444 |

TABLE 3-continued

Complement Component C3 unmodified sequences

| Duplex Name | Sense Sequence 5' to 3' | SEQ ID NO: | Range in NM_000064.3 | Antisense Sequence 5' to 3' | SEQ ID NO: |
|---|---|---|---|---|---|
| AD-76715 | UGGCUGAUCCUGGAGAAGA | 177 | 3409-3427 | UCUUCUCCAGGAUCAGCCA | 445 |
| AD-76733 | CAGAAGCCCGACGGGGUCU | 178 | 3427-3445 | AGACCCCGUCGGGCUUCUG | 446 |
| AD-76706 | GUCUUCCAGGAGGAUGCGA | 179 | 3442-3460 | UCGCAUCCUCCUGGAAGAC | 447 |
| AD-76561 | CCCGUGAUACACCAAGAAA | 180 | 3460-3478 | UUUCUUGGUGUAUCACGGG | 448 |
| AD-76669 | AUGAUUGGUGGAUUACGGA | 181 | 3478-3496 | UCCGUAAUCCACCAAUCAU | 449 |
| AD-76845 | AACAACAACGAGAAAGACA | 182 | 3496-3514 | UGUCUUUCUCGUUGUUGUU | 450 |
| AD-76859 | UUUGUUCUCAUCUCGCUGA | 183 | 3529-3547 | UCAGCGAGAUGAGAACAAA | 451 |
| AD-76888 | CAGGAGGCUAAAGAUAUUU | 184 | 3547-3565 | AAAUAUCUUUAGCCUCCUG | 452 |
| AD-76701 | UUGCGAGGAGCAGGUCAAA | 185 | 3564-3582 | UUUGACCUGCUCCUCGCAA | 453 |
| AD-76725 | ACAGCCUGCCAGGCAGCAU | 186 | 3581-3599 | AUGCUGCCUGGCAGGCUGU | 454 |
| AD-76728 | GCCUGCCAGGCAGCAUCAA | 187 | 3584-3602 | UUGAUGCUGCCUGGCAGGC | 455 |
| AD-76653 | CUAAAGCAGGAGACUUCCU | 188 | 3602-3620 | AGGAAGUCUCCUGCUUUAG | 456 |
| AD-76687 | CUUGAAGCCAACUACAUGA | 189 | 3619-3637 | UCAUGUAGUUGGCUUCAAG | 457 |
| AD-76595 | UACAUGAACCUACAGAGAU | 190 | 3631-3649 | AUCUCUGUAGGUUCAUGUA | 458 |
| AD-76617 | AUCCUACACUGUGGCCAUU | 191 | 3648-3666 | AAUGGCCACAGUGUAGGAU | 459 |
| AD-76874 | UUGCUGGCUAUGCUCUGGA | 192 | 3665-3683 | UCCAGAGCAUAGCCAGCAA | 460 |
| AD-76565 | GAAGGGGCCUCUUCUUAAA | 193 | 3699-3717 | UUUAAGAAGAGGCCCCUUC | 461 |
| AD-76849 | CAAAUUUCUGACCACAGCA | 194 | 3717-3735 | UGCUGUGGUCAGAAAUUUG | 462 |
| AD-76587 | CAAAGAUAAGAACCGCUGA | 195 | 3735-3753 | UCAGCGGUUCUUAUCUUUG | 463 |
| AD-76567 | GGGAGGACCCUGGUAAGCA | 196 | 3752-3770 | UGCUUACCAGGGUCCUCCC | 464 |
| AD-76686 | GACCCUGGUAAGCAGCUCU | 197 | 3757-3775 | AGAGCUGCUUACCAGGGUC | 465 |
| AD-76911 | UACAACGUGGAGGCCACAU | 198 | 3775-3793 | AUGUGGCCUCCACGUUGUA | 466 |
| AD-76895 | CCUAUGCCCUCUUGGCCCU | 199 | 3794-3812 | AGGGCCAAGAGGGCAUAGG | 467 |
| AD-76712 | UACUGCAGCUAAAAGACUU | 200 | 3812-3830 | AAGUCUUUUAGCUGCAGUA | 468 |
| AD-76634 | CGUCGUGCGUUGGCUCAAU | 201 | 3846-3864 | AUUGAGCCAACGCACGACG | 469 |
| AD-76558 | CAAUGAACAGAGAUACUAA | 202 | 3861-3879 | UUAGUAUCUCUGUUCAUUG | 470 |
| AD-76863 | ACGGUGGUGGCUAUGGCUA | 203 | 3878-3896 | UAGCCAUAGCCACCACCGU | 471 |
| AD-76901 | UCUACCCAGGCACCUUCA | 204 | 3895-3913 | UGAAGGUGGCCUGGGUAGA | 472 |
| AD-76898 | UUCAUGGUGUUCCAAGCCU | 205 | 3910-3928 | AGGCUUGGAACACCAUGAA | 473 |
| AD-76647 | CUUGGCUCAAUACCAAAAG | 206 | 3927-3945 | CUUUUGGUAUUGAGCCAAG | 474 |
| AD-76722 | AGGACGCCCCUGACCACCA | 207 | 3944-3962 | UGGUGGUCAGGGGCGUCCU | 475 |
| AD-76585 | CAGGAACUGAACCUUGAUA | 208 | 3961-3979 | UAUCAAGGUUCAGUUCCUG | 476 |
| AD-76586 | UUGAUGUGUCCCUCCAACU | 209 | 3974-3992 | AGUUGGAGGGACACAUCAA | 477 |
| AD-76857 | CUGCCCAGCCGCAGCUCCA | 210 | 3991-4009 | UGGAGCUGCGGCUGGGCAG | 478 |
| AD-76862 | CGCAGCUCCAAGAUCACCA | 211 | 4000-4018 | UGGUGAUCUUGGAGCUGCG | 479 |
| AD-76614 | CCACCGUAUCCACUGGAA | 212 | 4017-4035 | UUCCAGUGGAUACGGUGG | 480 |
| AD-76851 | CCGUAUCCACUGGGAAUCU | 213 | 4020-4038 | AGAUUCCCAGUGGAUACGG | 481 |

TABLE 3-continued

Complement Component C3 unmodified sequences

| Duplex Name | Sense Sequence 5' to 3' | SEQ ID NO: | Range in NM_000064.3 | Antisense Sequence 5' to 3' | SEQ ID NO: |
|---|---|---|---|---|---|
| AD-76569 | UGCCAGCCUCCUGCGAUCA | 214 | 4038-4056 | UGAUCGCAGGAGGCUGGCA | 482 |
| AD-76644 | AGAAGAGACCAAGGAAAAU | 215 | 4056-4074 | AUUUUCCUUGGUCUCUUCU | 483 |
| AD-76914 | AUGAGGGUUUCACAGUCAA | 216 | 4073-4091 | UUGACUGUGAAACCCUCAU | 484 |
| AD-76877 | ACAGCUGAAGGAAAAGGCA | 217 | 4090-4108 | UGCCUUUUCCUUCAGCUGU | 485 |
| AD-76881 | CCAAGGCACCUUGUCGGUA | 218 | 4107-4125 | UACCGACAAGGUGCCUUGG | 486 |
| AD-76912 | UUGUCGGUGGUGACAAUGU | 219 | 4117-4135 | ACAUUGUCACCACCGACAA | 487 |
| AD-76896 | GUACCAUGCUAAGGCCAAA | 220 | 4134-4152 | UUUGGCCUUAGCAUGGUAC | 488 |
| AD-76576 | CUAAGGCCAAAGAUCAACU | 221 | 4142-4160 | AGUUGAUCUUUGGCCUUAG | 489 |
| AD-76584 | CAACUCACCUGUAAUAAAU | 222 | 4156-4174 | AUUUAUUACAGGUGAGUUG | 490 |
| AD-76714 | UUCGACCUCAAGGUCACCA | 223 | 4174-4192 | UGGUGACCUUGAGGUCGAA | 491 |
| AD-76904 | UCACCAUAAAACCAGCACA | 224 | 4187-4205 | UGUGCUGGUUUUAUGGUGA | 492 |
| AD-76648 | CGGAAACAGAAAAGAGGCA | 225 | 4205-4223 | UGCCUCUUUUCUGUUUCCG | 493 |
| AD-76906 | UCAGGAUGCCAAGAACACU | 226 | 4224-4242 | AGUGUUCUUGGCAUCCUGA | 494 |
| AD-76623 | UAUGAUCCUUGAGAUCUGU | 227 | 4242-4260 | ACAGAUCUCAAGGAUCAUA | 495 |
| AD-76720 | CCAGGUACCGGGGAGACCA | 228 | 4262-4280 | UGGUCUCCCCGGUACCUGG | 496 |
| AD-76922 | CAGGAUGCCACUAUGUCUA | 229 | 4279-4297 | UAGACAUAGUGGCAUCCUG | 497 |
| AD-76836 | CUUUGCUCCAGACACAGAU | 230 | 4323-4341 | AUCUGUGUCUGGAGCAAAG | 498 |
| AD-76842 | AUGACCUGAAGCAGCUGGA | 231 | 4340-4358 | UCCAGCUGCUUCAGGUCAU | 499 |
| AD-76699 | UUGACAGAUACAUCUCCAA | 232 | 4367-4385 | UUGGAGAUGUAUCUGUCAA | 500 |
| AD-76855 | AAGUAUGAGCUGGACAAAG | 233 | 4384-4402 | CUUUGUCCAGCUCAUACUU | 501 |
| AD-76559 | UAUGAGCUGGACAAAGCCU | 234 | 4387-4405 | AGGCUUUGUCCAGCUCAUA | 502 |
| AD-76650 | CUUCUCCGAUAGGAACACA | 235 | 4404-4422 | UGUGUUCCUAUCGGAGAAG | 503 |
| AD-76601 | CCCUCAUCAUCUACCUGGA | 236 | 4421-4439 | UCCAGGUAGAUGAUGAGGG | 504 |
| AD-76734 | GACAAGGUCUCACACUCUA | 237 | 4438-4456 | UAGAGUGUGAGACCUUGUC | 505 |
| AD-76844 | UCACACUCUGAGGAUGACU | 238 | 4447-4465 | AGUCAUCCUCAGAGUGUGA | 506 |
| AD-76622 | GAGGAUGACUGUCUAGCUU | 239 | 4456-4474 | AAGCUAGACAGUCAUCCUC | 507 |
| AD-76880 | UUCAAAGUUCACCAAUACU | 240 | 4474-4492 | AGUAUUGGUGAACUUUGAA | 508 |
| AD-76683 | CUUUAAUGUAGAGCUUAUA | 241 | 4491-4509 | UAUAAGCUCUACAUUAAAG | 509 |
| AD-76690 | GUCAAGGUCUACGCCUAUU | 242 | 4522-4540 | AAUAGGCGUAGACCUUGAC | 510 |
| AD-76717 | UACAACCUGGAGGAAAGCU | 243 | 4540-4558 | AGCUUUCCUCCAGGUUGUA | 511 |
| AD-76661 | CUGUACCCGGUUCUACCAU | 244 | 4557-4575 | AUGGUAGAACCGGGUACAG | 512 |
| AD-76885 | AUCCGGAAAAGGAGGAUGA | 245 | 4574-4592 | UCAUCCUCCUUUUCCGGAU | 513 |
| AD-76887 | AAAGGAGGAUGGAAAGCU | 246 | 4580-4598 | AGCUUUCCAUCCUCCUUUU | 514 |
| AD-76645 | CUGAACAAGCUCUGCCGUA | 247 | 4597-4615 | UACGGCAGAGCUUGUUCAG | 515 |
| AD-76615 | UGAUGAACUGUGCCGCUGU | 248 | 4614-4632 | ACAGCGGCACAGUUCAUCA | 516 |
| AD-76579 | GUGCUGAGGAGAAUUGCUU | 249 | 4631-4649 | AAGCAAUUCUCCUCAGCAC | 517 |
| AD-76604 | AAUUGCUUCAUACAAAAGU | 250 | 4642-4660 | ACUUUUGUAUGAAGCAAUU | 518 |
| AD-76682 | GUCGGAUGACAAGGUCACA | 251 | 4659-4677 | UGUGACCUUGUCAUCCGAC | 519 |

TABLE 3-continued

Complement Component C3 unmodified sequences

| Duplex Name | Sense Sequence 5' to 3' | SEQ ID NO: | Range in NM_000064.3 | Antisense Sequence 5' to 3' | SEQ ID NO: |
|---|---|---|---|---|---|
| AD-76903 | CCCUGGAAGAACGGCUGGA | 252 | 4676-4694 | UCCAGCCGUUCUUCCAGGG | 520 |
| AD-76630 | GACAAGGCCUGUGAGCCAA | 253 | 4693-4711 | UUGGCUCACAGGCCUUGUC | 521 |
| AD-76575 | AGGCCUGUGAGCCAGGAGU | 254 | 4697-4715 | ACUCCUGGCUCACAGGCCU | 522 |
| AD-76917 | CCAGGAGUGGACUAUGUGU | 255 | 4708-4726 | ACACAUAGUCCACUCCUGG | 523 |
| AD-76886 | UACAAGACCCGACUGGUCA | 256 | 4726-4744 | UGACCAGUCGGGUCUUGUA | 524 |
| AD-76905 | UUCAGCUGUCCAAUGACUU | 257 | 4748-4766 | AAGUCAUUGGACAGCUGAA | 525 |
| AD-76856 | UUUGACGAGUACAUCAUGA | 258 | 4765-4783 | UCAUGAUGUACUCGUCAAA | 526 |
| AD-76737 | UACAUCAUGGCCAUUGAGA | 259 | 4774-4792 | UCUCAAUGGCCAUGAUGUA | 527 |
| AD-76659 | CAGACCAUCAAGUCAGGCU | 260 | 4792-4810 | AGCCUGACUUGAUGGUCUG | 528 |
| AD-76854 | CUCGGAUGAGGUGCAGGUU | 261 | 4809-4827 | AACCUGCACCUCAUCCGAG | 529 |
| AD-76711 | UUCAUCAGCCCCAUCAAGU | 262 | 4843-4861 | ACUUGAUGGGGCUGAUGAA | 530 |
| AD-76675 | UCAAGUGCAGAGAAGCCCU | 263 | 4856-4874 | AGGGCUUCUCUGCACUUGA | 531 |
| AD-76703 | CUGAAGCUGGAGGAGAAGA | 264 | 4873-4891 | UCUUCUCCUCCAGCUUCAG | 532 |
| AD-76707 | AAGCUGGAGGAGAAGAAAC | 265 | 4876-4894 | GUUUCUUCUCCUCCAGCUU | 533 |
| AD-76649 | ACACUACCUCAUGUGGGGU | 266 | 4893-4911 | ACCCCACAUGAGGUAGUGU | 534 |
| AD-76631 | UUCUGGGGAGAGAAGCCCA | 267 | 4924-4942 | UGGGCUUCUCUCCCCAGAA | 535 |
| AD-76598 | UACAUCAUCGGGAAGGACA | 268 | 4951-4969 | UGUCCUUCCCGAUGAUGUA | 536 |
| AD-76658 | CACUUGGGUGGAGCACUGA | 269 | 4968-4986 | UCAGUGCUCCACCCAAGUG | 537 |
| AD-76865 | AGGACGAAUGCCAAGACGA | 270 | 4994-5012 | UCGUCUUGGCAUUCGUCCU | 538 |
| AD-76697 | AAGAGAACCAGAAACAAUA | 271 | 5012-5030 | UAUUGUUUCUGGUUCUCUU | 539 |
| AD-76611 | UGCCAGGACCUCGGCGCCU | 272 | 5029-5047 | AGGCGCCGAGGUCCUGGCA | 540 |
| AD-76837 | CUUCACCGAGAGCAUGGUU | 273 | 5046-5064 | AACCAUGCUCUCGGUGAAG | 541 |
| AD-76704 | CACACCCCCAUUCCCCCAA | 274 | 5087-5105 | UUGGGGGAAUGGGGGUGUG | 542 |
| AD-76910 | CUCCAGAUAAAGCUUCAGU | 275 | 5105-5123 | ACUGAAGCUUUAUCUGGAG | 543 |
| AD-76870 | UUAUAUCUCAAAAAAAAAA | 276 | 5123-5141 | UUUUUUUUUUGAGAUAUAA | 544 |

TABLE 4

Complement Component C3 modified sequences

| Duplex Name | Sense Sequence 5' to 3' | SEQ ID NO: | Antisense Sequence 5' to 3' | SEQ ID NO: | mRNA target sequence | SEQ ID NO |
|---|---|---|---|---|---|---|
| AD-76619 | UCACUCCUCCCCAUCCUCUdTdT | 545 | AGAGGAUGGGGAGGAGUGAdTdT | 813 | UCACUCCUCCCCAUCCUCU | 1081 |
| AD-76864 | UCUGUCCCUCUGUCCCUCUdTdT | 546 | AGAGGGACAGAGGGACAGAdTdT | 814 | UCUGUCCCUCUGUCCCUCU | 1082 |
| AD-76867 | CAGCACCAUGGGACCCACAdTdT | 547 | UGUGGGUCCCAUGGUGCUGdTdT | 815 | CAGCACCAUGGGACCCACC | 1083 |
| AD-76667 | CCUCAGGUCCCAGCCUGCUdTdT | 548 | AGCAGGCUGGGACCUGAGGdTdT | 816 | CCUCAGGUCCCAGCCUGCU | 1084 |
| AD-76602 | CCAGCCUGCUGCUCCUGCUdTdT | 549 | AGCAGGAGCAGCAGGCUGGdTdT | 817 | CCAGCCUGCUGCUCCUGCU | 1085 |
| AD-76892 | UACUAACCCACCUCCCCCUdTdT | 550 | AGGGGGAGGUGGGUUAGUAdTdT | 818 | UACUAACCCACCUCCCCCU | 1086 |
| AD-76665 | UACUCUAUCAUCACCCCCAdTdT | 551 | UGGGGGUGAUGAUAGAGUAdTdT | 819 | UACUCUAUCAUCACCCCCA | 1087 |
| AD-76900 | CAACAUCUUGCGGCUGGAAdTdT | 552 | UUCCAGCCGCAAGAUGUUGdTdT | 820 | CAACAUCUUGCGGCUGGAG | 1088 |
| AD-76868 | AGAGCGAGGAGACCAUGGUdTdT | 553 | ACCAUGGUCUCCUCGCUCUdTdT | 821 | AGAGCGAGGAGACCAUGGU | 1089 |
| AD-76671 | UUCCAGUCACUGUUACUGUdTdT | 554 | ACAGUAACAGUGACUGGAAdTdT | 822 | UUCCAGUCACUGUUACUGU | 1090 |
| AD-76564 | UUCCCAGGCAAAAAACUAAdTdT | 555 | UUAGUUUUUGCCUGGGAAdTdT | 823 | UUCCCAGGCAAAAAACUAG | 1091 |
| AD-76600 | AGUGCUGUCCAGUGAGAAAdTdT | 556 | UUUCUCACUGGACAGCACUdTdT | 824 | AGUGCUGUCCAGUGAGAAG | 1092 |
| AD-76676 | AGACUGUGCUGACCCCUGAdTdT | 557 | UCAGGGGUCAGCACAGUCUdTdT | 825 | AGACUGUGCUGACCCCUGC | 1093 |

TABLE 4-continued

Complement Component C3 modified sequences

| Duplex Name | Sense Sequence 5' to 3' | SEQ ID NO: | Antisense Sequence 5' to 3' | SEQ ID NO: | mRNA target sequence | SEQ ID NO |
|---|---|---|---|---|---|---|
| AD-76915 | CAGGGAGUUCAAGUCAGAAdTdT | 558 | UUCUGACUUGAACUCCCUGdTdT | 826 | CAGGGAGUUCAAGUCAGAA | 1094 |
| AD-76577 | UUCAAGUCAGAAAAGGGGAdTdT | 559 | UCCCCUUUUCUGACUUGAAdTdT | 827 | UUCAAGUCAGAAAAGGGGC | 1095 |
| AD-76560 | UUCGUGACCGUGCAGGCCAdTdT | 560 | UGGCCUGCACGGUCACGAAdTdT | 828 | UUCGUGACCGUGCAGGCCA | 1096 |
| AD-76664 | CAGGCCACCUUCGGGACCAdTdT | 561 | UGGUCCCGAAGGUGGCCUGdTdT | 829 | CAGGCCACCUUCGGGACCC | 1097 |
| AD-76889 | CAAGUGGUGGAGAAGGUGAdTdT | 562 | UCACCUUCUCCACCACUUGdTdT | 830 | CAAGUGGUGGAGAAGGUGG | 1098 |
| AD-76718 | GUGCUGGUCAGCCUGCAGAdTdT | 563 | UCUGCAGGCUGACCAGCACdTdT | 831 | GUGCUGGUCAGCCUGCAGA | 1099 |
| AD-76606 | AGCGGGUACCUCUUCAUCAdTdT | 564 | UGAUGAAGAGGUACCCGCUdTdT | 832 | AGCGGGUACCUCUUCAUCC | 1100 |
| AD-76685 | CAGACAGACAAGACCAUCUdTdT | 565 | AGAUGGUCUUGUCUGUCUGdTdT | 833 | CAGACAGACAAGACCAUCU | 1101 |
| AD-76599 | CUACACCCCUGGCUCCACAdTdT | 566 | UGUGGAGCCAGGGGUGUAGdTdT | 834 | CUACACCCCUGGCUCCACA | 1102 |
| AD-76678 | ACAGUUCUCUAUCGGAUCUdTdT | 567 | AGAUCCGAUAGAGAACUGUdTdT | 835 | ACAGUUCUCUAUCGGAUCU | 1103 |
| AD-76670 | UUCACCGUCAACCACAAGAdTdT | 568 | UCUUGUGGUUGACGGUGAAdTdT | 836 | UUCACCGUCAACCACAAGC | 1104 |
| AD-76609 | GGACGUCAUGGUCAACAUdTdT | 569 | AUGUUGACCAUGACCGUCCdTdT | 837 | GGACGUCAUGGUCAACAU | 1105 |
| AD-76616 | UUGAGAACCCGGAAGGCAUdTdT | 570 | AUGCCUUCCGGGUUCUCAAdTdT | 838 | UUGAGAACCCGGAAGGCAU | 1106 |
| AD-76629 | AUCCCGGUCAAGCAGGACUdTdT | 571 | AGUCCUGCUUGACCGGGAUdTdT | 839 | AUCCCGGUCAAGCAGGACU | 1107 |
| AD-76850 | CUCCUUGUCUUCUCAGAAAdTdT | 572 | UUUCUGAGAAGACAAGGAGdTdT | 840 | CUCCUUGUCUUCUCAGAAC | 1108 |
| AD-76847 | UUGUCUUCUCAGAACCAGAdTdT | 573 | UCUGGUUCUGAGAAGACAAdTdT | 841 | UUGUCUUCUCAGAACCAGC | 1109 |
| AD-76668 | GCUUGGCGUCUUGCCCUUAdTdT | 574 | UAAGGGCAAGACGCCAAGCdTdT | 842 | GCUUGGCGUCUUGCCCUUG | 1110 |
| AD-76920 | UGCCCUUGUCUUGGGACAUdTdT | 575 | AUGUCCCAAGACAAGGGCAdTdT | 843 | UGCCCUUGUCUUGGGACAU | 1111 |
| AD-76637 | AUGGGCCAGUGGAAGAUCCdTdT | 576 | UGAUCUUCCACUGGCCCAUdTdT | 844 | AUGGGCCAGUGGAAGAUCC | 1112 |
| AD-76627 | GCCAGUGGAAGAUCCGAGAdTdT | 577 | UCUCGGAUCUUCCACUGGCdTdT | 845 | GCCAGUGGAAGAUCCGAGC | 1113 |
| AD-76708 | CCUACUAUGAAAACUCACAdTdT | 578 | UGUGAGUUUUCAUAGUAGGdTdT | 846 | CCUACUAUGAAAACUCACC | 1114 |
| AD-76594 | CACUGAGUUUGAGGUGAAAdTdT | 579 | UUUCACCUCAAACUCAGUGdTdT | 847 | CACUGAGUUUGAGGUGAAG | 1115 |
| AD-76858 | UUUGAGGUGAAGGAGUACAdTdT | 580 | UGUACUCCUUCACCUCAAAdTdT | 848 | UUUGAGGUGAAGGAGUACG | 1116 |
| AD-76731 | CGUGCUGCCCAGUUUCGAAdTdT | 581 | UUCGAAACUGGGCAGCACGdTdT | 849 | CGUGCUGCCCAGUUUCGAG | 1117 |
| AD-76660 | AGGUCAUAGUGGAGCCUAAdTdT | 582 | UUAGGCUCCACUAUGACCUdTdT | 850 | AGGUCAUAGUGGAGCCUAC | 1118 |
| AD-76729 | CAGAGAAAUUCUACUACAUdTdT | 583 | AUGUAGUAGAAUUUCUCUGdTdT | 851 | CAGAGAAAUUCUACUACAU | 1119 |
| AD-76657 | UCUAUAACGAGAAGGGCCUdTdT | 584 | AGGCCCUUCGUUAUAGAdTdT | 852 | UCUAUAACGAGAAGGGCCU | 1120 |
| AD-76882 | CUGGAGGUCACCAUCACCAdTdT | 585 | UGGUGAUGGUGACCUCCAGdTdT | 853 | CUGGAGGUCACCAUCACCG | 1121 |
| AD-76674 | GCCAGGUUCCUCUACGGGAdTdT | 586 | UCCCGUAGAGGAACCUGGCdTdT | 854 | GCCAGGUUCCUCUACGGGA | 1122 |
| AD-76581 | AAGAAAGUGGAGGGAACUAdTdT | 587 | UAGUUCCCUCCACUUUCUUdTdT | 855 | AAGAAAGUGGAGGGAACUG | 1123 |
| AD-76684 | GGAACUGCCUUUGUCAUCUdTdT | 588 | AGAUGACAAAGGCAGUUCCdTdT | 856 | GGAACUGCCUUUGUCAUCU | 1124 |
| AD-76633 | UUCGGGAUCCAGGAUGGCAdTdT | 589 | UGCCAUCCUGGAUCCCGAAdTdT | 857 | UUCGGGAUCCAGGAUGGCG | 1125 |
| AD-76902 | CGAACAGAGGAUUUCCCUAdTdT | 590 | UAGGGAAAUCCUCUGUUCGdTdT | 858 | CGAACAGAGGAUUUCCCUG | 1126 |
| AD-76921 | UUUCCCUGCCUGAAUCCCUdTdT | 591 | AGGGAUUCAGGCAGGGAAAdTdT | 859 | UUUCCCUGCCUGAAUCCCU | 1127 |
| AD-76691 | CUCAAGCGCAUUCCGAUUAdTdT | 592 | UAAUCGGAAUGCGCUUGAGdTdT | 860 | CUCAAGCGCAUUCCGAUUG | 1128 |
| AD-76592 | UGAGGAUGGCUCGGGGGAAdTdT | 593 | UUCCCCCGAGCCAUCCUCAdTdT | 861 | UGAGGAUGGCUCGGGGGAG | 1129 |
| AD-76642 | AGGUUGUGCUGAGCCGGAAdTdT | 594 | UUCCGGCUCAGCACAACCUdTdT | 862 | AGGUUGUGCUGAGCCGGAA | 1130 |
| AD-76869 | UGCUGAGCCGGAAGGUACUdTdT | 595 | AGUACCUUCCGGCUCAGCAdTdT | 863 | UGCUGAGCCGGAAGGUACU | 1131 |
| AD-76716 | GGUACUGCUGGACGGGGUAdTdT | 596 | UACCCCGUCCAGCAGUACCdTdT | 864 | GGUACUGCUGGACGGGGUG | 1132 |
| AD-76689 | GCAGAACCCCGAGCAGAAdTdT | 597 | UUCUGCUCGGGGUUCUGCdTdT | 865 | GCAGAACCCCGAGCAGAA | 1133 |
| AD-76679 | UACGUGUCUGCCACCGUCAdTdT | 598 | UGACGGUGGCAGACACGUAdTdT | 866 | UACGUGUCUGCCACCGUCA | 1134 |
| AD-76563 | UUGCACUCAGGCAGUGACAdTdT | 599 | UGUCACUGCCUGAGUGCAAdTdT | 867 | UUGCACUCAGGCAGUGACA | 1135 |
| AD-76568 | AGGCAGAGCGCAGCGGGAUdTdT | 600 | AUCCCGCUGCGCUCUGCCUdTdT | 868 | AGGCAGAGCGCAGCGGGAU | 1136 |
| AD-76574 | UUCACCAAGACACCCAAGUdTdT | 601 | ACUUGGGUGUCUUGGUGAAdTdT | 869 | UUCACCAAGACACCCAAGU | 1137 |
| AD-76875 | ACCAAGACACCCAAGUACUdTdT | 602 | AGUACUUGGGUGUCUUGGUdTdT | 870 | ACCAAGACACCCAAGUACU | 1138 |
| AD-76677 | UUCAAACCAGGAAUGCCCUdTdT | 603 | AGGGCAUUCCUGGUUUGAAdTdT | 871 | UUCAAACCAGGAAUGCCCU | 1139 |
| AD-76861 | UCGUGACGAACCCUGAUGAdTdT | 604 | UCAUCAGGGUUCGUCACGAdTdT | 872 | UCGUGACGAACCCUGAUGG | 1140 |
| AD-76672 | UCCAGGGCGAGGACACUGUdTdT | 605 | ACAGUGUCCUCGCCCUGGAdTdT | 873 | UCCAGGGCGAGGACACUGU | 1141 |
| AD-76908 | GAGGACACUGUGCAGUCUCdTdT | 606 | UAGACUGCACAGUGUCCUCdTdT | 874 | GAGGACACUGUGCAGUCUC | 1142 |
| AD-76625 | CUAACCCAGGGAGAUGGCAdTdT | 607 | UGCCAUCUCCCUGGGUUAGdTdT | 875 | CUAACCCAGGGAGAUGGCG | 1143 |
| AD-76571 | CGUGGCCAAACUCAGCAUAdTdT | 608 | UAUGCUGAGUUUGGCCACGdTdT | 876 | CGUGGCCAAACUCAGCAUC | 1144 |
| AD-76580 | UCAACACACCCCAGCCAdTdT | 609 | UGGCUGGGGUGUGUUGAdTdT | 877 | UCAACACACACCCCAGCCA | 1145 |
| AD-76673 | CAGAAGCCCUUGAGCAUCAdTdT | 610 | UGAUGCUCAAGGGCUUCUGdTdT | 878 | CAGAAGCCCUUGAGCAUCA | 1146 |
| AD-76641 | UUGAGCAUCACGGUGCGCAdTdT | 611 | UGCGCACCGUGAUGCUCAAdTdT | 879 | UUGAGCAUCACGGUGCGCA | 1147 |
| AD-76695 | GAGCUCUCGGAGGCAGAGAdTdT | 612 | UCUCUGCCUCCGAGAGCUCdTdT | 880 | GAGCUCUCGGAGGCAGAGC | 1148 |
| AD-76666 | CAGGCUACCAGGACCAUGAdTdT | 613 | UCAUGGUCCUGGUAGCCUGdTdT | 881 | CAGGCUACCAGGACCAUGC | 1149 |
| AD-76853 | GCAGGCUCUGCCCUACAGAdTdT | 614 | UCUGUAGGGCAGAGCCUGCdTdT | 882 | GCAGGCUCUGCCCUACAGC | 1150 |
| AD-76639 | UACAGCACCGUGGGCAACUdTdT | 615 | AGUUGCCCACGGUGCUGUAdTdT | 883 | UACAGCACCGUGGGCAACU | 1151 |
| AD-76872 | CUCCAACAAUUACCUGCAUdTdT | 616 | AUGCAGGUAAUUGUUGGAGdTdT | 884 | CUCCAACAAUUACCUGCAU | 1152 |
| AD-76680 | CAGUGCUACGUACAGAGCUdTdT | 617 | AGCUCUGUACGUAGCACUGdTdT | 885 | CAGUGCUACGUACAGAGCU | 1153 |
| AD-76709 | UCAGACCCGGGGAGACCCUdTdT | 618 | AGGGUCUCCCCGGGUCUGAdTdT | 886 | UCAGACCCGGGGAGACCCU | 1154 |
| AD-76860 | GCGCCCACGAGGCCAAGAUdTdT | 619 | AUCUUGGCCUCGUGGGCGCdTdT | 887 | GCGCCCACGAGGCCAAGAU | 1155 |
| AD-76610 | UCCGCUACUACACCUACCUdTdT | 620 | AGGUAGGUGUAGUAGCGGAdTdT | 888 | UCCGCUACUACACCUACCU | 1156 |
| AD-76608 | CUGAUCAUGAACAAGGGCAdTdT | 621 | UGCCCUUGUUCAUGAUCAGdTdT | 889 | CUGAUCAUGAACAAGGGCA | 1157 |
| AD-76662 | CAGGCUGUUGAAGCGGGAdTdT | 622 | UCCCGCCUUCAACAGCCUGdTdT | 890 | CAGGCUGUUGAAGGCGGGA | 1158 |
| AD-76899 | GACGCCAGGUGCGAGAGCCAdTdT | 623 | UGCUCUCGCACCUGGCGUCdTdT | 891 | GACGCCAGGUGCGAGAGCC | 1159 |
| AD-76640 | CCCGGCCAGGACCUGGUGAdTdT | 624 | UCACCAGGUCCUGGCCGGGdTdT | 892 | CCCGGCCAGGACCUGGUGG | 1160 |
| AD-76705 | UUCCGCCUGGUGGCGUACUdTdT | 625 | AGUACGCCACCAGGCGGAAdTdT | 893 | UUCCGCCUGGUGGCGUACU | 1161 |
| AD-76866 | CUACACGCUGAUCGGUGCAdTdT | 626 | UGCACCGAUCAGCGUGUAGdTdT | 894 | CUACACGCUGAUCGGUGCC | 1162 |
| AD-76652 | UGGGUGGACGUCAAGGACUdTdT | 627 | AGUCCUUGACGUCCACCCAdTdT | 895 | UGGGUGGACGUCAAGGACU | 1163 |
| AD-76838 | CCUGCGUGGGCUCGCUGGUdTdT | 628 | ACCAGCGAGCCCACGCAGGdTdT | 896 | CCUGCGUGGGCUCGCUGGU | 1164 |
| AD-76636 | UGGUAAAAAGCGGCCAGUAdTdT | 629 | UACUGGCCGCUUUUUACCAdTdT | 897 | UGGUAAAAAGCGGCCAGUC | 1165 |
| AD-76848 | CAGAAGACCGGCAGCCUGUdTdT | 630 | ACAGGCUGCCGGUCUUCUGdTdT | 898 | CAGAAGACCGGCAGCCUGU | 1166 |
| AD-76655 | CCUGGGCAGCAGAUGACCAdTdT | 631 | UGGUCAUCUGCUGCCCAGGdTdT | 899 | CCUGGGCAGCAGAUGACCC | 1167 |

TABLE 4-continued

Complement Component C3 modified sequences

| Duplex Name | Sense Sequence 5' to 3' | SEQ ID NO: | Antisense Sequence 5' to 3' | SEQ ID NO: | mRNA target sequence | SEQ ID NO |
|---|---|---|---|---|---|---|
| AD-76700 | CUGAAGAUAGAGGGUGACAdTdT | 632 | UGUCACCCUCUAUCUUCAGdTdT | 900 | CUGAAGAUAGAGGGUGACC | 1168 |
| AD-76583 | CCACGGGGCCCGGGUGGUAdTdT | 633 | UACCACCCGGGCCCGUGGdTdT | 901 | CCACGGGGCCCGGGUGGUA | 1169 |
| AD-76919 | ACUGGUGGCCGUGGACAAAdTdT | 634 | UUUGUCCACGGCCACCAGdTdT | 902 | ACUGGUGGCCGUGGACAAG | 1170 |
| AD-76681 | UAAGAAGAACAAACUGACAdTdT | 635 | UGUCAGUUUGUUCUUCUUAdTdT | 903 | UAAGAAGAACAAACUGACG | 1171 |
| AD-76724 | CGCAGAGUAAGAUCUGGGAdTdT | 636 | UCCCAGAUCUUACUCUGCGdTdT | 904 | CGCAGAGUAAGAUCUGGGA | 1172 |
| AD-76696 | GACGUGGUGGAGAAGGCAAdTdT | 637 | UUGCCUUCUCCACCACGUCdTdT | 905 | GACGUGGUGGAGAAGGCAG | 1173 |
| AD-76890 | ACCCCGGGCAGUGGGAAGAdTdT | 638 | UCUUCCCACUGCCCGGGGUdTdT | 906 | ACCCCGGGCAGUGGGAAGG | 1174 |
| AD-76638 | GAUUACGCCGGUGUCUUCUdTdT | 639 | AGAAGACACCGGCGUAAUCdTdT | 907 | GAUUACGCCGGUGUCUUCU | 1175 |
| AD-76883 | UCCGACGCAGGGCUGACCUdTdT | 640 | AGGUCAGCCCUGCGUCGGAdTdT | 908 | UCCGACGCAGGGCUGACCU | 1176 |
| AD-76839 | UUCACGAGCAGCAGUGGCAdTdT | 641 | UGCCACUGCUGCUCGUGAAdTdT | 909 | UUCACGAGCAGCAGUGGCC | 1177 |
| AD-76590 | CCAGCAGACCGCCCAGAGAdTdT | 642 | UCUCUGGGCGGUCUGCUGGdTdT | 910 | CCAGCAGACCGCCCAGAGG | 1178 |
| AD-76721 | CCGCCCAGAGGGCAGAACUdTdT | 643 | AGUUCUGCCCUCUGGGCGGdTdT | 911 | CCGCCCAGAGGGCAGAACU | 1179 |
| AD-76646 | UUCAGUGCCCGCAGCCAGAdTdT | 644 | UCUGGCUGCGGGCACUGAAdTdT | 912 | UUCAGUGCCCGCAGCCAGC | 1180 |
| AD-76605 | GCCGCCCGCCGACGCCGUUdTdT | 645 | AACGGCGUCGGCGGGCGGCdTdT | 913 | GCCGCCCGCCGACGCCGUU | 1181 |
| AD-76719 | ACGGAGAAGCGAAUGGACAdTdT | 646 | UGUCCAUUCGCUUCUCCGUdTdT | 914 | ACGGAGAAGCGAAUGGACA | 1182 |
| AD-76624 | AAAGUCGGCAAGUACCCCAdTdT | 647 | UGGGGUACUUGCCGACUUUdTdT | 915 | AAAGUCGGCAAGUACCCCA | 1183 |
| AD-76626 | CAAGGAGCUGCGCAAGUGAdTdT | 648 | UCACUUGCGCAGCUCCUUGdTdT | 916 | CAAGGAGCUGCGCAAGUGC | 1184 |
| AD-76603 | GCUGCGAGGACGGCAUGCAdTdT | 649 | UGCAUGCCGUCCUCGCAGCdTdT | 917 | GCUGCGAGGACGGCAUGCG | 1185 |
| AD-76846 | CCAUGAGGUUCUCGUGCCAdTdT | 650 | UGGCACGAGAACCUCAUGGdTdT | 918 | CCAUGAGGUUCUCGUGCCA | 1186 |
| AD-76635 | UUCUCGUGCCAGCGCCGGAdTdT | 651 | UCCGGCGCUGGCACGAGAAdTdT | 919 | UUCUCGUGCCAGCGCCGGA | 1187 |
| AD-76893 | CGUUUCAUCUCCCUGGGCAdTdT | 652 | UGCCCAGGGAGAUGAAACGdTdT | 920 | CGUUUCAUCUCCCUGGGCG | 1188 |
| AD-76923 | GAGGCGUGCAAGAAGGUCUdTdT | 653 | AGACCUUCUUGCACGCCUCdTdT | 921 | GAGGCGUGCAAGAAGGUCU | 1189 |
| AD-76736 | UUCCUGGACUGCUGCAACUdTdT | 654 | AGUUGCAGCAGUCCAGGAAdTdT | 922 | UUCCUGGACUGCUGCAACU | 1190 |
| AD-76566 | CUACAUCACAGAGCUGCGAdTdT | 655 | UCGCAGCUCUGUGAUGUAGdTdT | 923 | CUACAUCACAGAGCUGCGG | 1191 |
| AD-76656 | ACGCGCGGGCCAGCCACCUdTdT | 656 | AGGUGGCUGGCCCGCGCGUdTdT | 924 | ACGCGCGGGCCAGCCACCU | 1192 |
| AD-76596 | UGGGCCUGGCCAGGAGUAAdTdT | 657 | UUACUCCUGGCCAGGCCCAdTdT | 925 | UGGGCCUGGCCAGGAGUAA | 1193 |
| AD-76562 | ACCUGGAUGAGGACAUCAUdTdT | 658 | AUGAUGUCCUCAUCCAGGUdTdT | 926 | ACCUGGAUGAGGACAUCAU | 1194 |
| AD-76607 | UUGCAGAAGAGAACAUCGUdTdT | 659 | ACGAUGUUCUCUUCUGCAAdTdT | 927 | UUGCAGAAGAGAACAUCGU | 1195 |
| AD-76702 | GUUUCCCGAAGUGAGUUCAdTdT | 660 | UGAACUCACUUCGGGAAACdTdT | 928 | GUUUCCCGAAGUGAGUUCC | 1196 |
| AD-76879 | UUCCCAGAGAGCUGGCUGUdTdT | 661 | ACAGCCAGCUCUCUGGGAAdTdT | 929 | UUCCCAGAGAGCUGGCUGU | 1197 |
| AD-76663 | GUGGAACGUUGAGGACUUGdTdT | 662 | UAAGUCCUCAACGUUCCACdTdT | 930 | GUGGAACGUUGAGGACUUG | 1198 |
| AD-76913 | UUGAGGACUUGAAAGAGCAdTdT | 663 | UGCUCUUUCAAGUCCUCAAdTdT | 931 | UUGAGGACUUGAAAGAGCC | 1199 |
| AD-76909 | AGGACUUGAAAGAGCCACCdTdT | 664 | UGUGGCUCUUUCAAGUCCUdTdT | 932 | AGGACUUGAAAGAGCCACC | 1200 |
| AD-76843 | CGAAAAAUGGAAUCUCUAAdTdT | 665 | UUAGAGAUUCCAUUUUUCGdTdT | 933 | CGAAAAAUGGAAUCUCUAC | 1201 |
| AD-76597 | CUCUACGAAGCUCAUGAAUdTdT | 666 | AUUCAUGAGCUUCGUAGAGdTdT | 934 | CUCUACGAAGCUCAUGAAU | 1202 |
| AD-76732 | UAUAUUUUUGAAAGACUCCdTdT | 667 | UGAGUCUUUCAAAAAUAUAdTdT | 935 | UAUAUUUUUGAAAGACUCC | 1203 |
| AD-76871 | CCAUCACCACGUGGGAGAUdTdT | 668 | AUCUCCCACGUGGUGAUGGdTdT | 936 | CCAUCACCACGUGGGAGAU | 1204 |
| AD-76643 | AUUCUGGCUGUGAGCAUGUdTdT | 669 | ACAUGCUCACAGCCAGAAUdTdT | 937 | AUUCUGGCUGUGAGCAUGU | 1205 |
| AD-76621 | UCGGACAAGAAAGGGAUCUdTdT | 670 | AGAUCCCUUUCUUGUCCGAdTdT | 938 | UCGGACAAGAAAGGGAUCU | 1206 |
| AD-76884 | GCAGACCCCUUCGAGGUCAdTdT | 671 | UGACCUCGAAGGGGUCUGCdTdT | 939 | GCAGACCCCUUCGAGGUCA | 1207 |
| AD-76570 | UUCAUCGACCUGCGGCUAAdTdT | 672 | UUAGCCGCAGGUCGAUGAAdTdT | 940 | UUCAUCGACCUGCGGCUAC | 1208 |
| AD-76612 | ACCCUACUCUGUUGUUCGAdTdT | 673 | UCGAACAACAGAGUAGGGUdTdT | 941 | ACCCUACUCUGUUGUUCGA | 1209 |
| AD-76582 | CUGUUGUUCGAAACGAGCAdTdT | 674 | UGCUCGUUUCGAACAACAGdTdT | 942 | CUGUUGUUCGAAACGAGCA | 1210 |
| AD-76841 | CAGGUGGAAAUCCGAGCCGdTdT | 675 | UGGCUCGGAUUUCCACCUGdTdT | 943 | CAGGUGGAAAUCCGAGCCG | 1211 |
| AD-76620 | CGUUCUCUACAAUUACCGAdTdT | 676 | UCGGUAAUUGUAGAGAACGdTdT | 944 | CGUUCUCUACAAUUACCGG | 1212 |
| AD-76694 | AAGAGCUCAAGGUGAGGGUdTdT | 677 | ACCCUCACCUUGAGCUCUUdTdT | 945 | AAGAGCUCAAGGUGAGGGU | 1213 |
| AD-76632 | GUGGAACUACUCCACAAUAdTdT | 678 | UAUUGUGGAGUAGUUCCACdTdT | 946 | GUGGAACUACUCCACAAUC | 1214 |
| AD-76591 | UACUCCACAAUCCAGCCUUdTdT | 679 | AAGGCUGGAUUGUGGAGUAdTdT | 947 | UACUCCACAAUCCAGCCUU | 1215 |
| AD-76593 | UUCUGCAGCCUGGCCACCAdTdT | 680 | UGGUGGCCAGGCUGCAGAAdTdT | 948 | UUCUGCAGCCUGGCCACCA | 1216 |
| AD-76713 | CACCAAGAGGCGUCACCAdTdT | 681 | UUGGUGACGCCUCUUGGUGdTdT | 949 | CACCAAGAGGCGUCACCAG | 1217 |
| AD-76726 | AGCAGACCGUAACCAUCCAdTdT | 682 | UGGAUGGUUACGGUCUGCUdTdT | 950 | AGCAGACCGUAACCAUCCC | 1218 |
| AD-76793 | UCCUCGUUGUCCGUUCCAUdTdT | 683 | AUGGAACGGACAACGAGGAdTdT | 951 | UCCUCGUUGUCCGUUCCAU | 1219 |
| AD-76876 | UAUGUCAUCGUGCCGCUAAdTdT | 684 | UUAGCGGCACGAUGACAUAdTdT | 952 | UAUGUCAUCGUGCCGCUAA | 1220 |
| AD-76589 | AGACCGGCCUGCAGGAAGUdTdT | 685 | ACUUCCUGCAGGCCGGUCUdTdT | 953 | AGACCGGCCUGCAGGAAGU | 1221 |
| AD-76891 | GUGGAAGUCAAGGCUGCUAdTdT | 686 | UAGCAGCCUUGACUUCCACdTdT | 954 | GUGGAAGUCAAGGCUGCUG | 1222 |
| AD-76907 | UUCAUCAGUGACGGUGUCAdTdT | 687 | UGACACCGUCACUGAUGAAdTdT | 955 | UUCAUCAGUGACGGUGUCA | 1223 |
| AD-76613 | CAGGAAGUCCCUGAAGGUAdTdT | 688 | UACCUUCAGGGACUUCCUGdTdT | 956 | CAGGAAGUCCCUGAAGGUC | 1224 |
| AD-76572 | AAUCAGAAUGAACAAAACUdTdT | 689 | AGUUUUGUUCAUUCUGAUUdTdT | 957 | AAUCAGAAUGAACAAAACU | 1225 |
| AD-76873 | CUGUGGCUGUUCGCACCCUdTdT | 690 | AGGGUGCGAACAGCCACAGdTdT | 958 | CUGUGGCUGUUCGCACCCU | 1226 |
| AD-76654 | CUGGAUCCAGAACGCCUGAdTdT | 691 | UCAGGCGUUCUGGAUCCAGdTdT | 959 | CUGGAUCCAGAACGCCUGG | 1227 |
| AD-76578 | AAGGAGUGCAGAAAGAGGAdTdT | 692 | UCCUCUUUCUGCACUCCUUdTdT | 960 | AAGGAGUGCAGAAAGAGGA | 1228 |
| AD-76894 | GUGACCAAGUCCCGGACAAdTdT | 693 | UUGUCCGGGACUUGGUCACdTdT | 961 | GUGACCAAGUCCCGGACAC | 1229 |
| AD-76897 | CCGAGUCUGAGACCAGAAUdTdT | 694 | AUUCUGGUCUCAGACUCGGdTdT | 962 | CCGAGUCUGAGACCAGAAU | 1230 |
| AD-76628 | UUCUCCUGCAAGGGACCCAdTdT | 695 | UGGGUCCCUUGCAGGAGAAdTdT | 963 | UUCUCCUGCAAGGGACCCC | 1231 |
| AD-76688 | CCAGUGGCCCAGAUGAAUdTdT | 696 | UUGUCAUCUGGGCCACUGGdTdT | 964 | CCAGUGGCCCAGAUGACAG | 1232 |
| AD-76651 | CGUCGACGCGGAACGGCUAdTdT | 697 | UAGCCGUUCCGCGUCGACGdTdT | 965 | CGUCGACGCGGAACGGCUG | 1233 |
| AD-76692 | CGGGGAACAGAACAUGAUAdTdT | 698 | UAUCAUGUUCUGUUCCCCGdTdT | 966 | CGGGGAACAGAACAUGAUC | 1234 |
| AD-76588 | UCGGCAUGACGCCCACGGUdTdT | 699 | ACCGUGGGCGUCAUGCCGAdTdT | 967 | UCGGCAUGACGCCCACGGU | 1235 |
| AD-76916 | UACCUGGAUGAAACGGAAUdTdT | 700 | UCUCCGUUUCAUCCAGGUAdTdT | 968 | UACCUGGAUGAAACGGAAC | 1236 |
| AD-76918 | UGGAUGAAACGGAGCAGUAdTdT | 701 | UACUGCUCCGUUUCAUCCAdTdT | 969 | UGGAUGAAACGGAGCAGUG | 1237 |
| AD-76698 | GGGAGAAGUUCGGCCUAGAdTdT | 702 | UCUAGGCCGAACUUCUCCCdTdT | 970 | GGGAGAAGUUCGGCCUAGA | 1238 |
| AD-76723 | AGAAGCGGCAGGGGGCCUUdTdT | 703 | AAGGCCCCCUGCCGCUUCUdTdT | 971 | AGAAGCGGCAGGGGGCCUU | 1239 |
| AD-76735 | UUGGAGCUCAUCAAGAAGAdTdT | 704 | UCUUCUUGAUGAGCUCCAAdTdT | 972 | UUGGAGCUCAUCAAGAAGG | 1240 |
| AD-76710 | GAGCUCAUCAAGAAGGGGUdTdT | 705 | ACCCCUUCUUGAUGAGCUCdTdT | 973 | GAGCUCAUCAAGAAGGGGU | 1241 |

TABLE 4-continued

Complement Component C3 modified sequences

| Duplex Name | Sense Sequence 5' to 3' | SEQ ID NO: | Antisense Sequence 5' to 3' | SEQ ID NO: | mRNA target sequence | SEQ ID NO |
|---|---|---|---|---|---|---|
| AD-76852 | UACACCCAGCAGCUGGCCUdTdT | 706 | AGGCCAGCUGCUGGGUGUAdTdT | 974 | UACACCCAGCAGCUGGCCU | 1242 |
| AD-76840 | CUUCAGACAACCCAGCUCUdTdT | 707 | AGAGCUGGGUUGUCUGAAGdTdT | 975 | CUUCAGACAACCCAGCUCU | 1243 |
| AD-76727 | AGCUCUGCCUUUGCGGCCUdTdT | 708 | AGGCCGCAAAGGCAGAGCUdTdT | 976 | AGCUCUGCCUUUGCGGCCU | 1244 |
| AD-76573 | UUCGUGAAACGGGCACCCAdTdT | 709 | UGGGUGCCCGUUUCACGAAdTdT | 977 | UUCGUGAAACGGGCACCCA | 1245 |
| AD-76878 | CAGCACCUGGCUGACCGCAdTdT | 710 | UGCGGUCAGCCAGGUGCUGdTdT | 978 | CAGCACCUGGCUGACCGCC | 1246 |
| AD-76618 | UACGUGGUCAAGGUCUUCUdTdT | 711 | AGAAGACCUUGACCACGUAdTdT | 979 | UACGUGGUCAAGGUCUUCU | 1247 |
| AD-76730 | CUCUCUGGCUGUCAACCUAdTdT | 712 | UAGGUUGACAGCCAGAGAGdTdT | 980 | CUCUCUGGCUGUCAACCUC | 1248 |
| AD-76715 | UGGCUGAUCCUGGAGAAGAdTdT | 713 | UCUUCUCCAGGAUCAGCCAdTdT | 981 | UGGCUGAUCCUGGAGAAGC | 1249 |
| AD-76733 | CAGAAGCCCGACGGGGUCUdTdT | 714 | AGACCCCGUCGGGCUUCUGdTdT | 982 | CAGAAGCCCGACGGGGUCU | 1250 |
| AD-76706 | GUCUUCCAGGAGGAUGCGAdTdT | 715 | UCGCAUCCUCCUGGAAGACdTdT | 983 | GUCUUCCAGGAGGAUGCGC | 1251 |
| AD-76561 | CCCGUGAUACACCAAGAAAdTdT | 716 | UUUCUUGGUGUAUCACGGGdTdT | 984 | CCCGUGAUACACCAAGAAA | 1252 |
| AD-76669 | AUGAUUGGUGGAUUACGGAdTdT | 717 | UCCGUAAUCCACCAAUCAUdTdT | 985 | AUGAUUGGUGGAUUACGGA | 1253 |
| AD-76845 | AACAACAACGAGAAAGACAdTdT | 718 | UGUCUUUCUCGUUGUUGUUdTdT | 986 | AACAACAACGAGAAAGACA | 1254 |
| AD-76859 | UUUGUUCUCAUCUCGCUGAdTdT | 719 | UCAGCGAGAUGAGAACAAAdTdT | 987 | UUUGUUCUCAUCUCGCUGC | 1255 |
| AD-76888 | CAGGAGGCUAAAGAUAUUUdTdT | 720 | AAAUAUCUUUAGCCUCCUGdTdT | 988 | CAGGAGGCUAAAGAUAUUU | 1256 |
| AD-76701 | UUGCGAGGAGCAGGUCAACdTdT | 721 | UUUGACCUGCUCCUCGCAAdTdT | 989 | UUGCGAGGAGCAGGUCAAC | 1257 |
| AD-76725 | ACAGCCUGCCAGGCAGCAUdTdT | 722 | AUGCUGCCUGGCAGGCUGUdTdT | 990 | ACAGCCUGCCAGGCAGCAU | 1258 |
| AD-76728 | GCCUGCCAGGCAGCAUCAAdTdT | 723 | UUGAUGCUGCCUGGCAGGCdTdT | 991 | GCCUGCCAGGCAGCAUCAC | 1259 |
| AD-76653 | CUAAAGCAGGAGACUUCCUdTdT | 724 | AGGAAGUCUCCUGCUUUAGdTdT | 992 | CUAAAGCAGGAGACUUCCU | 1260 |
| AD-76687 | CUUGAAGCCAACUACAUGAdTdT | 725 | UCAUGUAGUUGGCUUCAAGdTdT | 993 | CUUGAAGCCAACUACAUGA | 1261 |
| AD-76595 | UACAUGAACCUACAGAGAUdTdT | 726 | AUCUCUGUAGGUUCAUGUAdTdT | 994 | UACAUGAACCUACAGAGAU | 1262 |
| AD-76617 | AUCCUACACUGUGGCCAUUdTdT | 727 | AAUGGCCACAGUGUAGGAUdTdT | 995 | AUCCUACACUGUGGCCAUU | 1263 |
| AD-76874 | UUGCUGGCCUAUGCUCUGGCdTdT | 728 | UCCAGACAGCAUGCAAdTdT | 996 | UUGCUGGCCUAUGCUCUGGC | 1264 |
| AD-76565 | GAAGGGGCCUCUUCUUAAAdTdT | 729 | UUUAAGAAGAGGCCCCUUCdTdT | 997 | GAAGGGGCCUCUUCUUAAC | 1265 |
| AD-76849 | CAAAUUUCUGACCACAGCAdTdT | 730 | UGCUGUGGUCAGAAAUUUGdTdT | 998 | CAAAUUUCUGACCACAGCC | 1266 |
| AD-76587 | CAAAGAUAAGAACCGCUGAdTdT | 731 | UCAGCGGUUCUUAUCUUUGdTdT | 999 | CAAAGAUAAGAACCGCUGG | 1267 |
| AD-76567 | GGGAGGACCCUGGUAAGCAdTdT | 732 | UGCUUACCAGGGUCCUCCdTdT | 1000 | GGGAGGACCCUGGUAAGCA | 1268 |
| AD-76686 | GACCCUGGUAAGCAGCUCUdTdT | 733 | AGAGCUGCUUACCAGGGUCdTdT | 1001 | GACCCUGGUAAGCAGCUCU | 1269 |
| AD-76911 | UACAACGUGGAGGCCACAUdTdT | 734 | AUGUGGCCUCCACGUUGUAdTdT | 1002 | UACAACGUGGAGGCCACAU | 1270 |
| AD-76895 | CCUAUGCCCUCUUGGCCCUdTdT | 735 | AGGGCCAAGAGGGCAUAGGdTdT | 1003 | CCUAUGCCCUCUUGGCCCU | 1271 |
| AD-76712 | UACUGCAGCUAAAAGACUUdTdT | 736 | AAGUCUUUUAGCUGCAGUAdTdT | 1004 | UACUGCAGCUAAAAGACUU | 1272 |
| AD-76634 | CGUCGUGCGUUGGCUCAAUdTdT | 737 | AUUGAGCCAACGCACGACGdTdT | 1005 | CGUCGUGCGUUGGCUCAAU | 1273 |
| AD-76558 | CAAUGAACAGAGAUACUAAdTdT | 738 | UUAGUAUCUCUGUUCAUUGdTdT | 1006 | CAAUGAACAGAGAUACUAC | 1274 |
| AD-76863 | ACGGUGGUGGCUAUGGCUAdTdT | 739 | UAGCCAUAGCCACCACCGUdTdT | 1007 | ACGGUGGUGGCUAUGGCUC | 1275 |
| AD-76901 | UCUACCCAGGCCACCUUCAdTdT | 740 | UGAAGGUGGCCUGGGUAGAdTdT | 1008 | UCUACCCAGGCCACCUUCA | 1276 |
| AD-76898 | UUCAUGGUGUCCAAGCCUdTdT | 741 | AGGCUUGGACACCAUGAAdTdT | 1009 | UUCAUGGUGUUCCAAGCCU | 1277 |
| AD-76647 | CUUGGCUCAAUACCAAAAGdTdT | 742 | CUUUUGGUAUUGAGCCAAGdTdT | 1010 | CUUGGCUCAAUACCAAAAG | 1278 |
| AD-76722 | AGGACGCCCCUGACCACCAdTdT | 743 | UGGUGGUCAGGGGCGUCCUdTdT | 1011 | AGGACGCCCCUGACCACCA | 1279 |
| AD-76585 | CAGGAACUGAACCUUGAUAdTdT | 744 | UAUCAAGGUUCAGUUCCUGdTdT | 1012 | CAGGAACUGAACCUUGAUG | 1280 |
| AD-76586 | UUGAUGUGUCCCUCCAACUdTdT | 745 | AGUUGGAGGGACACAUCAAdTdT | 1013 | UUGAUGUGUCCCUCCAACU | 1281 |
| AD-76857 | CUGCCCAGCCGCAGCUCCAdTdT | 746 | UGGAGCUGCGGCUGGGCAGdTdT | 1014 | CUGCCCAGCCGCAGCUCCA | 1282 |
| AD-76862 | CGCAGCUCCAAGAUCACCCdTdT | 747 | UGGUGAUCUUGGAGCUGCGdTdT | 1015 | CGCAGCUCCAAGAUCACCC | 1283 |
| AD-76614 | CCACCGUAUCCACUGGGAAdTdT | 748 | UUCCCAGUGGAUACGGUGGdTdT | 1016 | CCACCGUAUCCACUGGGAA | 1284 |
| AD-76851 | CCGUAUCCACUGGGAAUCUdTdT | 749 | AGAUUCCCAGUGGAUACGGdTdT | 1017 | CGUAUCCACUGGGAAUCU | 1285 |
| AD-76569 | UGCCAGCCUCCUGCGAUCAdTdT | 750 | UGAUCGCAGGAGGCUGGCAdTdT | 1018 | UGCCAGCCUCCUGCGAUCA | 1286 |
| AD-76644 | AGAAGAGACCAAGGAAAAUdTdT | 751 | AUUUUCCUUGGUCUCUUCUdTdT | 1019 | AGAAGAGACCAAGGAAAAU | 1287 |
| AD-76914 | AUGAGGGUUUCACAGUCAdTdT | 752 | UUGACUGUGAAACCCUCAUdTdT | 1020 | AUGAGGGUUUCACAGUCAC | 1288 |
| AD-76877 | ACAGCUGAAGGAAAAGGCAdTdT | 753 | UGCCUUUUCCUUCAGCUGUdTdT | 1021 | ACAGCUGAAGGAAAAGGCC | 1289 |
| AD-76881 | CCAAGGCACCUUGUCGGUAdTdT | 754 | UACCGACAAGGUGCCUUGGdTdT | 1022 | CCAAGGCACCUUGUCGGUG | 1290 |
| AD-76912 | UUGUCGGUGGUGACAAUGUdTdT | 755 | ACAUUGUCACCACCGACAAdTdT | 1023 | UUGUCGGUGGUGACAAUGU | 1291 |
| AD-76896 | GUACCAUGCUAAGGCCAAAdTdT | 756 | UUUGGCCUUAGCAUGGUACdTdT | 1024 | GUACCAUGCUAAGGCCAAA | 1292 |
| AD-76576 | CUAAGGCCAAAGAUCAACUdTdT | 757 | AGUUGAUCUUUGGCCUUAGdTdT | 1025 | CUAAGGCCAAAGAUCAACU | 1293 |
| AD-76584 | CAACUCACCUGUAAUAAAUdTdT | 758 | AUUUAUUACAGGUGAGUUGdTdT | 1026 | CAACUCACCUGUAAUAAAU | 1294 |
| AD-76714 | UUCGACCUCAAGGUCACCAdTdT | 759 | UGGUGACCUUGAGGUCGAAdTdT | 1027 | UUCGACCUCAAGGUCACCA | 1295 |
| AD-76904 | UCACCAUAAAACCAGCACAdTdT | 760 | UGUGCUGGUUUUAUGGUGAdTdT | 1028 | UCACCAUAAAACCAGCACC | 1296 |
| AD-76648 | CGGAAACAGAAAAGAGGCCdTdT | 761 | UGCCUCUUUUCUGUUUCCGdTdT | 1029 | CGGAAACAGAAAAGAGGCC | 1297 |
| AD-76906 | UCAGGAUGCCAAGAACACUdTdT | 762 | AGUGUUCUUGGCAUCCUGAdTdT | 1030 | UCAGGAUGCCAAGAACACU | 1298 |
| AD-76623 | UAUGAUCCUUGAGAUCUGUdTdT | 763 | ACAGAUCUCAAGGAUCAUAdTdT | 1031 | UAUGAUCCUUGAGAUCUGU | 1299 |
| AD-76720 | CCAGGUACCGGGGAGACCAdTdT | 764 | UGGUCUCCCCGGUACCUGGdTdT | 1032 | CCAGGUACCGGGGAGACCA | 1300 |
| AD-76922 | CAGGAUGCCACUAUGUCUAdTdT | 765 | UAGACAUAGUGGCAUCCUGdTdT | 1033 | CAGGAUGCCACUAUGUCUA | 1301 |
| AD-76836 | CUUUGCUCCAGACACAGAUdTdT | 766 | AUCUGUGUCUGGAGCAAAGdTdT | 1034 | CUUUGCUCCAGACACAGAU | 1302 |
| AD-76842 | AUGACCUGAAGCAGCUGGAdTdT | 767 | UCCAGCUGCUUCAGGUCAUdTdT | 1035 | AUGACCUGAAGCAGCUGGC | 1303 |
| AD-76699 | UUGACAGAUACAUCUCCAdTdT | 768 | UUGGAGAUGUAUCUGUCAAdTdT | 1036 | UUGACAGAUACAUCUCCAA | 1304 |
| AD-76855 | AAGUAUGAGCUGGACAAAGdTdT | 769 | CUUUGUCCAGCUCAUACUUdTdT | 1037 | AAGUAUGAGCUGGACAAAG | 1305 |
| AD-76559 | UAUGAGCUGGACAAAGCCUdTdT | 770 | AGGCUUUGUCCAGCUCAUAdTdT | 1038 | UAUGAGCUGGACAAAGCCU | 1306 |
| AD-76650 | CUUCUCCGAUAGGAACACCdTdT | 771 | UGUGUUCCUAUCGGAGAAGdTdT | 1039 | CUUCUCCGAUAGGAACACC | 1307 |
| AD-76601 | CCCUCAUCAUCUACCUGGAdTdT | 772 | UCCAGGUAGAUGAUGAGGGdTdT | 1040 | CCCUCAUCAUCUACCUGGA | 1308 |
| AD-76734 | GACAAGGUCUCACACUCUAdTdT | 773 | UAGAGUGUGAGACCUUGUCdTdT | 1041 | GACAAGGUCUCACACUCUG | 1309 |
| AD-76844 | UCACACUCUGAGGAAUGACdTdT | 774 | AGUCAUUCCUCAGAGUGUGAdTdT | 1042 | UCACACUCUGAGGAAUGAC | 1310 |
| AD-76622 | GAGGAUGACUGUCUAGCUUdTdT | 775 | AAGCUAGACAGUCAUCCUCdTdT | 1043 | GAGGAUGACUGUCUAGCUU | 1311 |
| AD-76880 | UUCAAAGUUCACCAAUACUdTdT | 776 | AGUAUUGGUGAACUUUGAAdTdT | 1044 | UUCAAAGUUCACCAAUACU | 1312 |
| AD-76683 | CUUUAAUGUAGAGCUUAUAdTdT | 777 | UAUAAGCUCUACAUUAAAGdTdT | 1045 | CUUUAAUGUAGAGCUUAUC | 1313 |
| AD-76690 | GUCAAGGUCUACGCCUAUUdTdT | 778 | AAUAGGCGUAGACCUUGACdTdT | 1046 | GUCAAGGUCUACGCCUAUU | 1314 |
| AD-76717 | UACAACCUGGAGGAAAGCUdTdT | 779 | AGCUUUCCUCCAGGUUGUAdTdT | 1047 | UACAACCUGGAGGAAAGCU | 1315 |

TABLE 4-continued

Complement Component C3 modified sequences

| Duplex Name | Sense Sequence 5' to 3' | SEQ ID NO: | Antisense Sequence 5' to 3' | SEQ ID NO: | mRNA target sequence | SEQ ID NO |
|---|---|---|---|---|---|---|
| AD-76661 | CUGUACCCGGUUCUACCAUdTdT | 780 | AUGGUAGAACCGGGUACAGdTdT | 1048 | CUGUACCCGGUUCUACCAU | 1316 |
| AD-76885 | AUCCGGAAAAGGAGGAUGAdTdT | 781 | UCAUCCUCCUUUUCCGGAUdTdT | 1049 | AUCCGGAAAAGGAGGAUGG | 1317 |
| AD-76887 | AAAAGGAGGAUGGAAAGCUdTdT | 782 | AGCUUUCCAUCCUCCUUUUdTdT | 1050 | AAAAGGAGGAUGGAAAGCU | 1318 |
| AD-76645 | CUGAACAAGCUCUGCCGUAdTdT | 783 | UACGGCAGAGCUUGUUCAGdTdT | 1051 | CUGAACAAGCUCUGCCGUG | 1319 |
| AD-76615 | UGAUGAACUGUGCCGCUGUdTdT | 784 | ACAGCGGCACAGUUCAUCAdTdT | 1052 | UGAUGAACUGUGCCGCUGU | 1320 |
| AD-76579 | GUGCUGAGGAGAAUUGCUUdTdT | 785 | AAGCAAUUCUCCUCAGCACdTdT | 1053 | GUGCUGAGGAGAAUUGCUU | 1321 |
| AD-76604 | AAUUGCUUCAUACAAAAGUdTdT | 786 | ACUUUUGUAUGAAGCAAUUdTdT | 1054 | AAUUGCUUCAUACAAAAGU | 1322 |
| AD-76682 | GUCGGAUGACAAGGUCACAdTdT | 787 | UGUGACCUUGUCAUCCGACdTdT | 1055 | GUCGGAUGACAAGGUCACC | 1323 |
| AD-76903 | CCCUGGAAGAACGGCUGGAdTdT | 788 | UCCAGCCGUUCUUCCAGGGdTdT | 1056 | CCCUGGAAGAACGGCUGGA | 1324 |
| AD-76630 | GACAAGGCCUGUGAGCCAAdTdT | 789 | UUGGCUCACAGGCCUUGUCdTdT | 1057 | GACAAGGCCUGUGAGCCAG | 1325 |
| AD-76575 | AGGCCUGUGAGCCAGGAGUdTdT | 790 | ACUCCUGGCUCACAGGCCUdTdT | 1058 | AGGCCUGUGAGCCAGGAGU | 1326 |
| AD-76917 | CCAGGAGUGGACUAUGUGUdTdT | 791 | ACACAUAGUCCACUCCUGGdTdT | 1059 | CCAGGAGUGGACUAUGUGU | 1327 |
| AD-76886 | UACAAGACCCGACUGGUCAdTdT | 792 | UGACCAGUCGGGUCUUGUAdTdT | 1060 | UACAAGACCCGACUGGUCA | 1328 |
| AD-76905 | UUCAGCUGUCCAAUGACUUdTdT | 793 | AAGUCAUUGGACAGCUGAAdTdT | 1061 | UUCAGCUGUCCAAUGACUU | 1329 |
| AD-76856 | UUUGCAGAGUACAUCAUGGdTdT | 794 | UCAUGAUGUACUCGUCAAAdTdT | 1062 | UUUGCAGAGUACAUCAUGG | 1330 |
| AD-76737 | UACAUCAUGGCCAUUGAGCdTdT | 795 | UCUCAAUGGCCAUGAUGUAdTdT | 1063 | UACAUCAUGGCCAUUGAGC | 1331 |
| AD-76659 | CAGACCAUCAAGUCAGGCUdTdT | 796 | AGCCUGACUUGAUGGUCUGdTdT | 1064 | CAGACCAUCAAGUCAGGCU | 1332 |
| AD-76854 | CUCGGAUGAGGUGCAGGUUdTdT | 797 | AACCUGCACCUCAUCCGAGdTdT | 1065 | CUCGGAUGAGGUGCAGGUU | 1333 |
| AD-76711 | UUCAUCAGCCCCAUCAAGUdTdT | 798 | ACUUGAUGGGGCUGAUGAAdTdT | 1066 | UUCAUCAGCCCCAUCAAGU | 1334 |
| AD-76675 | UCAAGUGCAGAAGCCCUdTdT | 799 | AGGGCUUCUCUGCACUUGAdTdT | 1067 | UCAAGUGCAGAAGCCCU | 1335 |
| AD-76703 | CUGAAGCUGGAGGAGAAGAdTdT | 800 | UCUUCUCCUCCAGCUUCAdTdT | 1068 | CUGAAGCUGGAGGAGAAGA | 1336 |
| AD-76707 | AAGCUGGAGGAGAAGAAACdTdT | 801 | GUUUCUUCUCCUCCAGCUUdTdT | 1069 | AAGCUGGAGGAGAAGAAAC | 1337 |
| AD-76649 | ACACUACCUCAUGUGGGGUdTdT | 802 | ACCCCACUCAUGUGGGGUdTdT | 1070 | ACACUACCUCAUGUGGGGU | 1338 |
| AD-76631 | UUCUGGGGAGAAGCCCAdTdT | 803 | UGGGCUUCUCUCCCCAGAAdTdT | 1071 | UUCUGGGGAGAAGCCCA | 1339 |
| AD-76598 | UACAUCAUCGGGAAGGACAdTdT | 804 | UGUCCUUCCCGAUGAUGUAdTdT | 1072 | UACAUCAUCGGGAAGGACA | 1340 |
| AD-76658 | CACUUGGGUGGAGCACUGAdTdT | 805 | UCAGUGCUCCACCCAAGUGdTdT | 1073 | CACUUGGGUGGAGCACUGG | 1341 |
| AD-76865 | AGGACGAAUGCCAAGACGAdTdT | 806 | UCGUCUUGGCAUUCGUCCUdTdT | 1074 | AGGACGAAUGCCAAGACGA | 1342 |
| AD-76697 | AAGAGAACCAGAAACAAUAdTdT | 807 | UAUUGUUUCUGGUUCUCUUdTdT | 1075 | AAGAGAACCAGAAACAAUG | 1343 |
| AD-76611 | UGCCAGGACCUCGGCGCCUdTdT | 808 | AGGCGCCGAGGUCCUGGCAdTdT | 1076 | UGCCAGGACCUCGGCGCCU | 1344 |
| AD-76837 | CUUCACCGAGAGCAUGGUUdTdT | 809 | AACCAUGCUCUCGGUGAAGdTdT | 1077 | CUUCACCGAGAGCAUGGUU | 1345 |
| AD-76704 | CACACCCCCAUUCCCCAAdTdT | 810 | UUGGGGGAAUGGGGGUGUGdTdT | 1078 | CACACCCCCAUUCCCCAC | 1346 |
| AD-76910 | CUCCAGAUAAAGCUUCAGUdTdT | 811 | ACUGAAGCUUUAUCUGGAGdTdT | 1079 | CUCCAGAUAAAGCUUCAGU | 1347 |
| AD-76870 | UUAUAUCUCAAAAAAAAAAdTdT | 812 | UUUUUUUUUUGAGAUAUAAdTdT | 1080 | UUAUAUCUCAAAAAAAAAA | 1348 |

TABLE 5

C3 single dose screen in Hep3B Cells

| Duplex Name | 10 nM_AVG |
|---|---|
| AD-76619 | 81.34 |
| AD-76864 | 67.41 |
| AD-76867 | 27.87 |
| AD-76667 | 48.22 |
| AD-76602 | 24.86 |
| AD-76892 | 63.99 |
| AD-76665 | 36.80 |
| AD-76900 | 55.29 |
| AD-76868 | 33.73 |
| AD-76671 | 40.23 |
| AD-76564 | 36.81 |
| AD-76600 | 16.61 |
| AD-76676 | 39.51 |
| AD-76915 | 18.67 |
| AD-76577 | 68.52 |
| AD-76560 | 75.89 |
| AD-76664 | 35.74 |
| AD-76889 | 62.28 |
| AD-76718 | 42.42 |
| AD-76606 | 21.79 |
| AD-76685 | 52.44 |
| AD-76599 | 17.98 |
| AD-76678 | 32.71 |
| AD-76670 | 75.69 |
| AD-76609 | 19.35 |
| AD-76616 | 24.23 |
| AD-76629 | 91.18 |
| AD-76850 | 14.52 |
| AD-76847 | 20.03 |
| AD-76668 | 55.13 |
| AD-76920 | 31.43 |
| AD-76637 | 15.16 |
| AD-76627 | 27.57 |
| AD-76708 | 19.49 |
| AD-76594 | 27.17 |
| AD-76858 | 80.97 |
| AD-76731 | 22.06 |
| AD-76660 | 20.21 |
| AD-76729 | 45.79 |
| AD-76657 | 79.53 |
| AD-76882 | 76.50 |
| AD-76674 | 37.79 |
| AD-76581 | 16.70 |
| AD-76684 | 26.49 |
| AD-76633 | 70.67 |
| AD-76902 | 25.01 |
| AD-76921 | 125.85 |
| AD-76691 | 86.09 |
| AD-76592 | 42.69 |
| AD-76642 | 14.96 |
| AD-76869 | 33.52 |
| AD-76716 | 40.09 |
| AD-76689 | 75.31 |
| AD-76679 | 59.40 |
| AD-76563 | 72.41 |
| AD-76568 | 17.15 |
| AD-76574 | 91.25 |
| AD-76875 | 19.37 |
| AD-76677 | 95.01 |
| AD-76861 | 32.98 |
| AD-76672 | 60.88 |
| AD-76908 | 31.11 |

TABLE 5-continued

C3 single dose screen in Hep3B Cells

| Duplex Name | 10 nM_AVG |
| --- | --- |
| AD-76625 | 37.69 |
| AD-76571 | 21.83 |
| AD-76580 | 47.71 |
| AD-76673 | 39.40 |
| AD-76641 | 111.17 |
| AD-76695 | 80.59 |
| AD-76666 | 40.92 |
| AD-76853 | 80.21 |
| AD-76639 | 93.17 |
| AD-76872 | 31.84 |
| AD-76680 | 31.17 |
| AD-76709 | 99.88 |
| AD-76860 | 36.14 |
| AD-76610 | 73.21 |
| AD-76608 | 33.75 |
| AD-76662 | 41.33 |
| AD-76899 | 41.36 |
| AD-76640 | 108.20 |
| AD-76705 | 102.72 |
| AD-76866 | 19.58 |
| AD-76652 | 86.39 |
| AD-76838 | 40.48 |
| AD-76636 | 55.70 |
| AD-76848 | 23.54 |
| AD-76655 | 39.58 |
| AD-76700 | 56.96 |
| AD-76583 | 34.13 |
| AD-76919 | 53.18 |
| AD-76681 | 34.21 |
| AD-76724 | 37.68 |
| AD-76696 | 37.46 |
| AD-76890 | 79.00 |
| AD-76638 | 28.31 |
| AD-76883 | 95.52 |
| AD-76839 | 27.13 |
| AD-76590 | 26.38 |
| AD-76721 | 49.09 |
| AD-76646 | 55.65 |
| AD-76605 | 56.71 |
| AD-76719 | 36.27 |
| AD-76624 | 35.67 |
| AD-76626 | 13.23 |
| AD-76603 | 25.01 |
| AD-76846 | 13.95 |
| AD-76635 | 71.91 |
| AD-76893 | 70.30 |
| AD-76923 | 14.76 |
| AD-76736 | 76.07 |
| AD-76566 | 16.47 |
| AD-76656 | 91.79 |
| AD-76596 | 31.65 |
| AD-76562 | 32.29 |
| AD-76607 | 24.46 |
| AD-76702 | 41.34 |
| AD-76879 | 37.36 |
| AD-76663 | 40.58 |
| AD-76913 | 18.98 |
| AD-76909 | 12.99 |
| AD-76843 | 20.73 |
| AD-76597 | 18.30 |
| AD-76732 | 59.81 |
| AD-76871 | 31.99 |
| AD-76643 | 55.95 |
| AD-76621 | 101.39 |
| AD-76884 | 64.51 |
| AD-76570 | 19.64 |
| AD-76612 | 9.79 |
| AD-76582 | 15.82 |
| AD-76841 | 43.31 |
| AD-76620 | 24.98 |
| AD-76694 | 62.42 |
| AD-76632 | 95.95 |
| AD-76591 | 80.65 |
| AD-76593 | 76.64 |
| AD-76713 | 41.37 |
| AD-76726 | 43.50 |
| AD-76693 | 25.77 |
| AD-76876 | 37.92 |
| AD-76589 | 18.53 |
| AD-76891 | 44.75 |
| AD-76907 | 51.95 |
| AD-76613 | 18.94 |
| AD-76572 | 38.55 |
| AD-76873 | 32.94 |
| AD-76654 | 59.32 |
| AD-76578 | 25.23 |
| AD-76894 | 60.08 |
| AD-76897 | 22.16 |
| AD-76628 | 96.02 |
| AD-76688 | 40.23 |
| AD-76651 | 43.03 |
| AD-76692 | 39.71 |
| AD-76588 | 38.94 |
| AD-76916 | 41.62 |
| AD-76918 | 26.98 |
| AD-76698 | 22.86 |
| AD-76723 | 50.03 |
| AD-76735 | 82.32 |
| AD-76710 | 41.56 |
| AD-76852 | 88.88 |
| AD-76840 | 29.70 |
| AD-76727 | 37.73 |
| AD-76573 | 67.80 |
| AD-76878 | 93.21 |
| AD-76618 | 72.24 |
| AD-76730 | 24.79 |
| AD-76715 | 36.05 |
| AD-76733 | 69.47 |
| AD-76706 | 42.66 |
| AD-76561 | 62.17 |
| AD-76669 | 32.82 |
| AD-76845 | 17.88 |
| AD-76859 | 59.92 |
| AD-76888 | 22.05 |
| AD-76701 | 42.50 |
| AD-76725 | 37.85 |
| AD-76728 | 37.43 |
| AD-76653 | 29.14 |
| AD-76687 | 33.86 |
| AD-76595 | 16.28 |
| AD-76617 | 34.00 |
| AD-76874 | 109.06 |
| AD-76565 | 34.94 |
| AD-76849 | 17.38 |
| AD-76587 | 25.22 |
| AD-76567 | 10.51 |
| AD-76686 | 36.45 |
| AD-76911 | 100.13 |
| AD-76895 | 29.67 |
| AD-76712 | 32.13 |
| AD-76634 | 24.10 |
| AD-76558 | 10.63 |
| AD-76863 | 71.47 |
| AD-76901 | 70.63 |
| AD-76898 | 74.44 |
| AD-76647 | 83.55 |
| AD-76722 | 32.39 |
| AD-76585 | 20.68 |
| AD-76586 | 84.87 |
| AD-76857 | 12.21 |
| AD-76862 | 28.25 |
| AD-76614 | 18.38 |
| AD-76851 | 22.39 |
| AD-76569 | 31.93 |
| AD-76644 | 15.98 |
| AD-76914 | 12.42 |
| AD-76877 | 25.10 |
| AD-76881 | 24.21 |
| AD-76912 | 87.11 |
| AD-76896 | 11.00 |
| AD-76576 | 12.13 |
| AD-76584 | 13.33 |

TABLE 5-continued

C3 single dose screen in Hep3B Cells

| Duplex Name | 10 nM_AVG |
|---|---|
| AD-76714 | 106.13 |
| AD-76904 | 28.26 |
| AD-76648 | 40.30 |
| AD-76906 | 42.29 |
| AD-76623 | 59.80 |
| AD-76720 | 33.09 |
| AD-76922 | 15.26 |
| AD-76836 | 35.31 |
| AD-76842 | 36.07 |
| AD-76699 | 28.16 |
| AD-76855 | 58.60 |
| AD-76559 | 145.64 |
| AD-76650 | 48.94 |
| AD-76601 | 18.08 |
| AD-76734 | 30.89 |
| AD-76844 | 67.03 |
| AD-76622 | 15.09 |
| AD-76880 | 42.08 |
| AD-76683 | 34.59 |
| AD-76690 | 35.14 |
| AD-76717 | 67.15 |
| AD-76661 | 75.24 |
| AD-76885 | 37.96 |
| AD-76887 | 58.41 |
| AD-76645 | 20.75 |
| AD-76615 | 33.03 |
| AD-76579 | 33.22 |
| AD-76604 | 40.15 |
| AD-76682 | 57.20 |
| AD-76903 | 24.85 |
| AD-76630 | 23.33 |
| AD-76575 | 27.72 |
| AD-76917 | 24.56 |
| AD-76886 | 21.18 |
| AD-76905 | 47.24 |
| AD-76856 | 48.22 |
| AD-76737 | 90.72 |
| AD-76659 | 38.68 |
| AD-76854 | 31.17 |
| AD-76711 | 76.77 |
| AD-76675 | 75.87 |
| AD-76703 | 45.76 |
| AD-76707 | 49.43 |
| AD-76649 | 98.60 |
| AD-76631 | 49.95 |
| AD-76598 | 21.87 |
| AD-76658 | 57.29 |
| AD-76865 | 13.17 |
| AD-76697 | 29.14 |
| AD-76611 | 94.88 |
| AD-76837 | 27.39 |
| AD-76704 | 107.56 |
| AD-76910 | 19.44 |
| AD-76870 | 69.16 |

TABLE 6

Additional Complement Component C3 unmodified sense and antisense strand sequences

| Duplex Name | Sense Sequence 5' to 3' | SEQ ID NO: | Range | Antisense Sequence 5' to 3' | SEQ ID NO: | Transcript |
|---|---|---|---|---|---|---|
| AD-60165.1 | GCUGAGGAGAAUUGCUUCAUA | 1353 | 4602-4622 | UAUGAAGCAAUUCUCCUCAGCAC | 1410 | NM_000064.2 |
| AD-60153.1 | GGAGAAUUGCUUCAUACAAAA | 1354 | 4607-4627 | UUUUGUAUGAAGCAAUUCUCCUC | 1411 | NM_000064.2 |
| AD-60175.1 | GCAGCUAAAAGACUUUGACUU | 1355 | 3785-3805 | AAGUCAAAGUCUUUUAGCUGCAG | 1412 | NM_000064.2 |
| AD-60169.1 | AUCCAGACAGACAAGACCAUU | 1356 | 456-476 | AAUGGUCUUGUCUGUCUGGAUGA | 1413 | NM_000064.2 |
| AD-60187.1 | GACAGACAAGACCAUCUACAA | 1357 | 461-481 | UUGUAGAUGGUCUUGUCUGUCUG | 1414 | NM_000064.2 |
| AD-60149.1 | CGUGGUCAAGGUCUUCUCUCU | 1358 | 3305-3325 | AGAGAAGACCUUGACCACGUA | 1415 | NM_000064.2 |
| AD-60171.1 | UCCAGACAGACAAGACCAUCU | 1359 | 457-477 | AGAUGGUCUUGUCUGUCUGGAUG | 1416 | NM_000064.2 |
| AD-60160.1 | AUGAACAAAACUGUGGCUGUU | 1360 | 2874-2894 | AACAGCCACAGUUUUGUUCAUUC | 1417 | NM_000064.2 |
| AD-60206.1 | CUUCAUGGUAUUCCAAGCCUU | 1361 | 3917-3937 | AAGGCUUGGAAUACCAUGAAGGU | 1418 | NM_009778.2 |
| AD-60176.1 | CAUCCAGACAGACAAGACCAU | 1362 | 455-475 | AUGGUCUUGUCUGUCUGGAUGAA | 1419 | NM_000064.2 |
| AD-60156.1 | CCAGACAGACAAGACCAUCUA | 1363 | 458-478 | UAGAUGGUCUUGUCUGUCUGGAU | 1420 | NM_000064.2 |
| AD-60155.1 | GACAGACAAGACCAUCUACAC | 1364 | 461-481 | GUGUAGAUGGUCUUGUCUGUCUG | 1421 | NM_000064.2 |
| AD-60183.1 | UACGUGGUCAAGGUCUUCUCU | 1365 | 3303-3323 | AGAGAAGACCUUGACCACGUAGG | 1422 | NM_000064.2 |
| AD-60161.1 | AGACAGACAAGACCAUCUACA | 1366 | 460-480 | UGUAGAUGGUCUUGUCUGUCUGG | 1423 | NM_000064.2 |
| AD-60166.1 | ACGUGGUCAAGGUCUUCUCUC | 1367 | 3304-3324 | GAGAGAAGACCUUGACCACGUAG | 1424 | NM_000064.2 |
| AD-60201.1 | AGAAAAUGGAAUCUCUACGA | 1368 | 2446-2466 | UCGUAGAGAUUCCAUUUUUCUCU | 1425 | NM_009778.2 |
| AD-60179.1 | UUUGACCUCAUGGUGUUCGUU | 1369 | 1170-1190 | AACGAACACCAUGAGGUCAAAGG | 1426 | NM_000064.2 |
| AD-60164.1 | GACAAGACCAUCUACACCCCU | 1370 | 465-485 | AGGGGUGUAGAUGGUCUUGUCUG | 1427 | NM_000064.2 |
| AD-60186.1 | GAAAGGGAUCUGUGUGGCAGA | 1371 | 2498-2518 | UCUGCCACACAGAUCCCUUUCUU | 1428 | NM_000064.2 |
| AD-60162.1 | CCAGAUCCACUUCACCAAGAC | 1372 | 1121-1141 | GUCUUGGUGAAGUGGAUCUGGUA | 1429 | NM_000064.2 |
| AD-60189.1 | UGUAAUAAAUUCGACCUCAAG | 1373 | 4134-4154 | CUUGAGGUCGAAUUUAUUACAGG | 1430 | NM_000064.2 |
| AD-60178.1 | AUCCAGACAGACAAGACCAUC | 1374 | 456-476 | GAUGGUCUUGUCUGUCUGGAUGA | 1431 | NM_000064.2 |
| AD-60194.1 | AACAAGAAGAACAAACUCACA | 1375 | 1914-1934 | UGUGAGUUUGUUCUUCUUGUUCA | 1432 | NM_009778.2 |
| AD-60199.1 | CUUCACCAAGACACCCAAAUU | 1376 | 1172-1192 | AAUUUGGGUGUCUUGGUGAAGUG | 1433 | NM_009778.2 |
| AD-60174.1 | UGACCUCAUGGUGUUCGUGAU | 1377 | 1172-1192 | AUCACGAACACCAUGAGGUCAAA | 1434 | NM_000064.2 |
| AD-60159.1 | CCCCUUCGAGGUCACAGUAAU | 1378 | 2519-2539 | AUUACUGUGACCUCGAAGGGGUC | 1435 | NM_000064.2 |
| AD-60168.1 | ACAGACAAGACCAUCUACACA | 1379 | 462-482 | UGUGUAGAUGGUCUUGUCUGUCU | 1436 | NM_000064.2 |
| AD-60198.1 | AUUCACCAAGAAAUGAUUGGU | 1380 | 3474-3494 | ACCAAUCAUUUCUUGGUGAAUCA | 1437 | NM_009778.2 |
| AD-60180.1 | GGAUGCCAAGAACACUAUGAU | 1381 | 4196-4216 | AUCAUAGUGUUCUUGGCAUCCUG | 1438 | NM_000064.2 |
| AD-60190.1 | AACUACAUGAACCUACAGAGA | 1382 | 3597-3617 | UCUCUGUAGGUUCAUGUAGUUGG | 1439 | NM_000064.2 |
| AD-60188.1 | UGACCUCAUGGUGUUCGUGAC | 1383 | 1172-1192 | GUCACGAACACCAUGAGGUCAAA | 1440 | NM_000064.2 |
| AD-60205.1 | CGUGACAGUGUGGCAAACUU | 1384 | 419-439 | AAGUUUGCCACCACUGUCACGUA | 1441 | NM_009778.2 |
| AD-60184.1 | CAGUUUCGAGGUCAUAGUGGA | 1385 | 752-772 | UCCACUAUGACCUCGAAACUGGG | 1442 | NM_009778.2 |
| AD-60163.1 | AGGGAUCUGUGUGGCAGACCA | 1386 | 2501-2521 | UGGUCUGCCACACAGAUCCCUUU | 1443 | NM_000064.2 |
| AD-60172.1 | AGGGAUCUGUGUGGCAGACCC | 1387 | 2501-2521 | GGGUCUGCCACACAGAUCCCUUU | 1444 | NM_000064.2 |
| AD-60151.1 | ACGUGGUCAAGGUCUUCUCUA | 1388 | 3304-3324 | UAGAGAAGACCUUGACCACGUAG | 1445 | NM_000064.2 |
| AD-60196.1 | UUGCCUUUGUCUUGGAACAUU | 1389 | 669-689 | AAUGUUCCAAGACAAAGGCAAGA | 1446 | NM_009778.2 |
| AD-60204.1 | CAUAGAAGAGUUGAAAGAACC | 1390 | 2423-2443 | GGUUCUUUCAACUCUUCUAUGGU | 1447 | NM_009778.2 |

TABLE 6-continued

Additional Complement Component C3 unmodified sense and antisense strand sequences

| Duplex Name | Sense Sequence 5' to 3' | SEQ ID NO: | Range | Antisense Sequence 5' to 3' | SEQ ID NO: | Transcript |
|---|---|---|---|---|---|---|
| AD-60185.1 | CGUGCCGGAAGGAAUCAGAAU | 1391 | 2855-2875 | AUUCUGAUUCCUUCCGGCACGAC | 1448 | NM_000064.2 |
| AD-60170.1 | CUCCGUGUGGGUGGACGUCAA | 1392 | 1709-1729 | UUGACGUCCACCCACACGGAGUC | 1449 | NM_000064.2 |
| AD-60158.1 | UUGACCUCAUGGUGUUCGUGA | 1393 | 1171-1191 | UCACGAACACCAUGAGGUCAAGG | 1450 | NM_000064.2 |
| AD-60200.1 | CUGCUGAAAGACUUUGACUCU | 1394 | 3825-3845 | AGAGUCAAAGUCUUUCAGCAGCA | 1451 | NM_009778.2 |
| AD-60173.1 | CAAGAAAGGGAUCUGUGUGGA | 1395 | 2495-2515 | UCCACACAGAUCCCUUUCUUGUC | 1452 | NM_000064.2 |
| AD-60181.1 | AAGAAAGGGAUCUGUGUGGCA | 1396 | 2496-2516 | UGCCACACAGAUCCCUUUCUUGU | 1453 | NM_000064.2 |
| AD-60152.1 | UUUGACCUCAUGGUGUUCGUG | 1397 | 1170-1190 | CACGAACACCAUGAGGUCAAAGG | 1454 | NM_000064.2 |
| AD-60197.1 | CACUGUGCAAGACUUCCUAAA | 1398 | 278-298 | UUUAGGAAGUCUUGCACAGUGAC | 1455 | NM_009778.2 |
| AD-60191.1 | CUGGUUGUGGACCAUAGAAGA | 1399 | 2411-2431 | UCUUCUAUGGUCCACAACCAGCU | 1456 | NM_009778.2 |
| AD-60154.1 | UGUUAAAUGGCUGAUCCUGGA | 1400 | 3371-3391 | UCCAGGAUCAGCCAUUUAACAGC | 1457 | NM_000064.2 |
| AD-60167.1 | GGAUCUGUGUGGCAGACCCCU | 1401 | 2503-2523 | AGGGGUCUGCCACACAGAUCCCU | 1458 | NM_000064.2 |
| AD-60177.1 | ACAGACAAGACCAUCUACACC | 1402 | 462-482 | GGUGUAGAUGGUCUUGUCUGUCU | 1459 | NM_000064.2 |
| AD-60195.1 | GUACGUGCAGUGGUGGCAAA | 1403 | 416-436 | UUUGCCACCACUGUCACGUACUU | 1460 | NM_009778.2 |
| AD-60193.1 | GGUCAUGAACAUCUUUCUCAA | 1404 | 2468-2488 | UUGAGAAAGAUGUUCAUGACCUU | 1461 | NM_009778.2 |
| AD-60202.1 | GUCGUGCCAGAAGGAAUGAGA | 1405 | 2892-2912 | UCUCAUUCCUUCUGGCACGACCU | 1462 | NM_009778.2 |
| AD-60182.1 | CAAGAAAGGGAUCUGUGUGGC | 1406 | 2495-2515 | GCCACACAGAUCCCUUUCUUGUC | 1463 | NM_000064.2 |
| AD-60203.1 | CUGUGCAAGACUUCCUAAAGA | 1407 | 280-300 | UCUUUAGGAAGUCUUGCACAGUG | 1464 | NM_009778.2 |
| AD-60157.1 | CCAGAUCCACUUCACCAAGAA | 1408 | 1121-1141 | UUCUUGGUGAAGUGGAUCUGGUA | 1465 | NM_000064.2 |
| AD-60192.1 | GCUGCUGAAAGACUUUGACUC | 1409 | 3824-3844 | GAGUCAAAGUCUUUCAGCAGCAG | 1466 | NM_009778.2 |

TABLE 7

Additional Complement Component C3 modified sense and antisense strand sequences

| Duplex Name | Sense Sequence 5' to 3' | SEQ ID NO: | Antisense Sequence 5' to 3' | SEQ ID NO: | mRNA target sequence | SEQ ID NO: |
|---|---|---|---|---|---|---|
| AD-60165.1 | GfscsUfgAfgGfaGfAfA fuUfgCfuUfcAfuAfL96 | 1467 | usAfsuGfaAfgCfaAfuucUfcCfuCfaGfcsas C | 1524 | GUGCUGAGGAGAAUUGCUU CAUA | 1581 |
| AD-60153.1 | GfsgsAfgAfaUfuGfCfU fuCfaUfaCfaAfaAfL96 | 1468 | usUfsuUfgUfaUfgAfagcAfaUfuCfcUfcsus C | 1525 | GAGGAGAAUUGCUUCAUAC AAAA | 1582 |
| AD-60175.1 | GfscsAfgCfuAfaAfAfG faCfuUfuGfuGfcGfcsas | 1469 | asAfsgUfcAfaAfgUfcuuUfuAfgCfuGfcsas g | 1526 | CUGCAGCUAAAAGACUUUG ACUU | 1583 |
| AD-60169.1 | AfsusCfcAfgAfcAfAfGfA fcAfaGfaCfcAfuAfL96 | 1470 | asAfsuGfgUfcUfuGfucuGfuCfuGfgAfusgs a | 1527 | UCAUCCAGACAGACAAGACC AUC | 1584 |
| AD-60187.1 | GfsasCfaGfaCfaAfgAfA fcCfaUfcUfaCfaCfL96 | 1471 | usUfsgUfaGfaUfgGfucuUfgUfcUfgUfcsus g | 1528 | CAGACAGACAAGACCAUCUA CAC | 1585 |
| AD-60149.1 | CfsgsUfgGfuCfaAfgGfG fuCfuUfcUfcUfcUfL96 | 1472 | asGfsaGfaGfaAfgAfccuUfgAfcCfaCfgsus a | 1529 | UACGUGGUCAAGGUCUUCU CUCU | 1586 |
| AD-60171.1 | UfscsCfaGfaCfaGfAfC faAfgAfcCfaUfcUfL96 | 1473 | asGfsaUfgGfuCfuUfgucUfgUfcUfgGfasus g | 1530 | CAUCCAGACAGACAAGACCA UCU | 1587 |
| AD-60160.1 | AfsusCfcAfgAfcAfAfC fuGfuGfgCfuGfuUfL96 | 1474 | asAfscAfgCfcAfcAfguuUfgUfuCfAfusus c | 1531 | GAAUGAACAAAACUGUGGC UGUU | 1588 |
| AD-60206.1 | CfsusUfcAfuGfgUfAfU fuCfcAfaGfcCfuUfL96 | 1475 | asAfsgGfcUfuGfgAfauaCfcAfuGfaAfgsgs u | 1532 | ACCUUCAUGGUAUUCCAAGC CUU | 1589 |
| AD-60176.1 | CfsasUfcCfaGfaCfAfG faCfaAfgAfcCfaUfL96 | 1476 | asUfsgGfuCfuUfgUfcugUfcUfgGfaUfgsas a | 1533 | UUCAUCCAGACAGACAAGAC CAU | 1590 |
| AD-60156.1 | CfscsAfgAfcAfgAfCfA faGfaCfcAfuCfuAfL96 | 1477 | usAfsgAfuGfgUfcUfuguCfuGfuCfuGfgsas u | 1534 | AUCCAGACAGACAAGACCAU CUA | 1591 |
| AD-60155.1 | GfsasCfaGfaCfaAfgAfA fcCfaUfcUfaCfaCfL96 | 1478 | gsUfsgUfaGfaUfgGfucuUfgUfcUfgUfcsus g | 1535 | CAGACAGACAAGACCAUCUA CAC | 1592 |
| AD-60183.1 | UfsasCfgUfgGfuCfAfA fgGfuCfuUfcUfcUfL96 | 1479 | asGfsaGfaAfgAfcCfuugAfcCfaCfgUfasgs g | 1536 | CCUACGUGGUCAAGGUCUUC UCU | 1593 |
| AD-60161.1 | AfsgsUfcAfgAfcAfAfG faCfcAfuCfuAfcAfL96 | 1480 | usGfsuUfaGfaUfgGfuucuUfcUfgUfcUfusg sg | 1537 | CCAGACAGACAAGACCAUCU ACA | 1594 |
| AD-60166.1 | AfscsGfuGfgUfcAfAfG fgUfcUfuCfuCfuCfL96 | 1481 | gsAfsgAfgAfaGfaCfcuuGfaCfcAfcGfusas g | 1538 | CUACGUGGUCAAGGUCUUC UCUC | 1595 |
| AD-60201.1 | AfsgsAfaAfaUfgGfAfA fuCfuCfuAfcGfaAfL96 | 1482 | usCfsgUfaGfaGfaUfuccAfuUfuUfuCfuscs u | 1539 | AGAGAAAAUGGAAUCUCU ACGA | 1596 |
| AD-60179.1 | UfsusUfgAfcCfuCfAfU fgGfuGfuUfcGfuUfL96 | 1483 | asAfscGfaAfcAfcCfaugAfgGfuCfaAfasgs g | 1540 | CCUUUGACCUCAUGGUGUUC GUG | 1597 |
| AD-60164.1 | GfsasCfaAfgAfcCfAfU fcUfaCfaCfcCfcUfL96 | 1484 | asGfsgGfgUfgUfaGfaugGfuCfuUfgUfcsus g | 1541 | CAGACAAGACCAUCUACACC CCU | 1598 |
| AD-60186.1 | GfsasAfaGfgGfaUfCfU fgUfgUfgGfcAfgAfL96 | 1485 | usCfsuGfcCfaCfaCfagaUfcCfcUfuUfcsus u | 1542 | AAGAAAGGGAUCUGUGUGG CAGA | 1599 |
| AD-60162.1 | CfscsAfgAfuCfCfAfU fuCfaCfcAfaGfaCfL96 | 1486 | gsUfscUfuGfgUfgAfaguGfgAfuCfuGfgsu sa | 1543 | UACCAGAUCCACUUCACCAA GAC | 1600 |
| AD-60189.1 | UfsgsUfaAfuAfAfUfU fcGfaCfcUfcAfgAfL96 | 1487 | csUfsuGfaGfgUfcGfaauUfuAfuUfaCfasgs g | 1544 | CCUGUAAUAAAUUCGACCUC AAG | 1601 |
| AD-60178.1 | AfsusCfcAfgAfcAfAfGfA fcAfaGfaCfcAfuCfuL96 | 1488 | gsAfsuGfgUfcUfuGfucuGfuCfuGfgAfusg sa | 1545 | UCAUCCAGACAGACAAGACC AUC | 1602 |

TABLE 7-continued

Additional Complement Component C3 modified sense and antisense strand sequences

| Duplex Name | Sense Sequence 5' to 3' | SEQ ID NO: | Antisense Sequence 5' to 3' | SEQ ID NO: | mRNA target sequence | SEQ ID NO: |
|---|---|---|---|---|---|---|
| AD-60194.1 | AfsasCfaAfgAfaGfAfA fcAfaAfcUfcAfcAfL96 | 1489 | usGfsuGfaGfuUfuGfuucUfuCfuUfgUfuscs a | 1546 | UGAACAAGAAGAACAAACU CACA | 1603 |
| AD-60199.1 | CfsusUfcAfcCfaAfgFfA fcAfcCfcAfaAfuUfL96 | 1490 | asAfsuUfuGfgGfuGfucuUfgGfuGfaAfgsu sg | 1547 | CACUUCACCAAGACACCCAA AUU | 1604 |
| AD-60174.1 | UfsgsAfcCfuCfaUfgGfG fuGfuUfcGfuGfaUfL96 | 1491 | asUfscAfcGfaAfcAfccaUfgAfgGfuCfasas a | 1548 | UUUGACCUCAUGGUGUUCG UGAC | 1605 |
| AD-60159.1 | CfscsCfcUfuCfgAfgGfG fuCfaCfaGfuAfaUfL96 | 1492 | asUfsuAfcUfgUfgAfccuCfgAfaGfgGfgsus c | 1549 | GACCCCUUCGAGGUCACAGU AAU | 1606 |
| AD-60168.1 | AfscsAfgAfcAfaGfAfC fcAfuCfuAfcAfcAfL96 | 1493 | usGfsuGfuAfgAfuGfgucUfuGfuCfuGfusc su | 1550 | AGACAGACAAGACCAUCUAC ACC | 1607 |
| AD-60198.1 | AfsusUfcAfcCfaAfgFfA faAfuGfaUfuGfgUfL96 | 1494 | asCfscAfaUfcAfuUfucuUfgGfuGfaAfuscs a | 1551 | UGAUUCACCAAGAAAUGAU UGGU | 1608 |
| AD-60180.1 | GfsgsAfuGfcCfaAfgFfA faCfaCfuAfuGfaUfL96 | 1495 | asUfscAfuAfgUfgUfucuUfgGfcAfuCfcsus g | 1552 | CAGGAUGCCAAGAACACUA UGAU | 1609 |
| AD-60190.1 | AfsasCfuAfcAfuGfAfA fcCfuAfcAfgAfgAfL96 | 1496 | usCfsuCfuGfuAfgGfuucAfuGfuAfgUfusg sg | 1553 | CCAACUACAUGAACCUACAG AGA | 1610 |
| AD-60188.1 | UfsgsAfcCfuCfaUfgGfG fuGfuUfcGfuGfaCfL96 | 1497 | gsUfscAfcGfaAfcAfccaUfgAfgGfuCfasas a | 1554 | UUUGACCUCAUGGUGUUCG UGAC | 1611 |
| AD-60205.1 | CfsgsUfgAfcAfgUfgFfG fuGfgCfaAfaCfuUfL96 | 1498 | asAfsgUfuUfgCfcAfccaCfuGfuCfaCfgsus a | 1555 | UACGUGACAGUGGUGGCAA ACUU | 1612 |
| AD-60184.1 | CfsasGfuUfuCfgAfgGfG fuCfaUfaGfuGfgAfL96 | 1499 | usCfscAfcUfaUfgAfccuCfgAfaAfcUfgsgs g | 1556 | CCCAGUUUCGAGGUCAUAG UGGA | 1613 |
| AD-60163.1 | AfsgsGfgAfuCfuGfUfG fuGfgCfaGfaCfcAfL96 | 1500 | usGfsgUfcUfgCfcAfcacAfgAfuCfcCfusus u | 1557 | AAAGGGAUCUGUGUGGCAG ACCC | 1614 |
| AD-60172.1 | AfsgsGfgAfuCfuGfUfG fuGfgCfaGfaCfcCfCfL96 | 1501 | gsGfsgUfcUfgCfcAfcacAfgAfuCfcCfusus u | 1558 | AAAGGGAUCUGUGUGGCAG ACCC | 1615 |
| AD-60151.1 | AfscsGfuGfgUfcAfAfG fgUfcUfuCfuCfuAfL96 | 1502 | usAfsgAfgAfaGfaCfcuuGfaCfcAfcGfusas g | 1559 | CUACGUGGUCAAGGUCUUC UCUC | 1616 |
| AD-60196.1 | UfsusGfcCfuUfuGfUfC fuUfgGfaAfcAfuUfL96 | 1503 | asAfsuGfuUfcCfaAfgacAfaAfgGfcAfasgs a | 1560 | UCUUGCCUUUGUCUUGGAA CAUU | 1617 |
| AD-60204.1 | CfsasUfaGfaAfgAfgFfU fuGfaAfaGfaAfcCfL96 | 1504 | gsGfsuUfcUfuUfcAfacuCfuUfcUfaUfgsgs u | 1561 | ACCAUAGAAGAGUUGAAAG AACC | 1618 |
| AD-60185.1 | CfsgsUfgCfcGfgAfAfG fgAfaUfcAfgAfaUfL96 | 1505 | asUfsuCfuGfaUfuCfcuuCfcGfgCfaCfgsas c | 1562 | GUCGUGCCGGAAGGAAUCA GAAU | 1619 |
| AD-60170.1 | CfsusCfcGfuGfuGfGfG fuGfgAfcGfuCfaAfL96 | 1506 | usUfsgAfcGfuCfcAfcccAfcAfcGfgAfgsus c | 1563 | GACUCCGUGUGGGUGGACG UCAA | 1620 |
| AD-60158.1 | UfsusGfaCfcUfcAfUfG fgUfgUfuCfgUfgAfL96 | 1507 | usCfsaCfgAfaCfaCfcauGfaGfgUfcAfasasg | 1564 | CUUUGACCUCAUGGUGUUC GUGA | 1621 |
| AD-60200.1 | CfsusGfcUfgAfaAfgFfA fcUfuUfgAfcUfcUfL96 | 1508 | asGfsaGfuCfaAfaGfucuUfuCfaGfcAfgscs a | 1565 | UGCUGCUGAAAGACUUUGA CUCU | 1622 |
| AD-60173.1 | CfsasAfgAfaAfgGfGfA fuCfuGfuGfuGfgAfL96 | 1509 | usCfscAfcAfcAfgAfuccCfuUfuCfuUfgsus c | 1566 | GACAAGAAAGGGAUCUGUG UGGC | 1623 |
| AD-60181.1 | AfsasGfaAfaGfgGfAfU fcUfgUfgUfgGfcAfL96 | 1510 | usGfsscCfaCfaCfaGfaucCfcUfuUfcUfusgs u | 1567 | ACAAGAAAGGGAUCUGUGU GGCA | 1624 |
| AD-60152.1 | UfsfsgAfcCfuCffAfU fgGfuGfuUfcGfuGfL96 | 1511 | csAfsfcGfaAfcAfcCfaugAfgGfuCfaAfasgs g | 1568 | CCUUUGACCUCAUGGUGUUC GUG | 1625 |
| AD-60197.1 | CfsasCfuGfuGfcAfAfG faCfuUfcCfuAfaAfL96 | 1512 | usUfsuAfgGfaAfgUfcuuGfcAfcAfgUfgsas c | 1569 | GUCACUGUGCAAGACUUCCU AAA | 1626 |
| AD-60191.1 | CfsgsUfgGfuUfgGfGfA fcCfaUfaGfaAfgAfL96 | 1513 | usCfsuUfcUfaUfgGfuccAfcAfaCfcAfgscs u | 1570 | AGCUGGUUGUGGACCAUAG AAGA | 1627 |
| AD-60154.1 | UfsgsUfuAfaAfuGfGfC fuGfaUfcCfuGfgAfL96 | 1514 | usCfscAfgGfaUfcAfgccAfuUfuAfaCfasgs c | 1571 | GCUGUUAAAUGGCUGAUCC UGGA | 1628 |
| AD-60167.1 | GfsgsAfuCfuGfuGfUfG fgCfaGfaCfcCfcUfL96 | 1515 | asGfsgGfgUfcUfgCfcacAfcAfgAfuCfcscs u | 1572 | AGGGAUCUGUGUGGCAGAC CCCU | 1629 |
| AD-60177.1 | AfscsAfgAfcAfaGfAfC fcAfuCfuAfcAfcCfL96 | 1516 | gsGfsuGfuAfgAfuGfgucUfuGfuCfuGfusc su | 1573 | AGACAGACAAGACCAUCUAC ACC | 1630 |
| AD-60195.1 | GfsusAfcGfuGfaCfAfG fuGfgUfgGfcAfaAfL96 | 1517 | usUfsuGfcCfaCfcAfcugUfcAfcGfuAfcsus u | 1574 | AAGUACGUGACAGUGGUGG CAAA | 1631 |
| AD-60193.1 | GfsgsUfcAfuGfaAfCfA fuCfuUfuCfaAfL96 | 1518 | usUfsgAfgAfaAfgAfuguUfcAfuGfaCfcsus u | 1575 | AAGGUCAUGAACAUCUUUC UCAA | 1632 |
| AD-60202.1 | GfsusCfgUfgCfcAfgFfA faGfgAfaUfgAfgAfL96 | 1519 | usCfsuCfaUfuCfcUfucuGfgCfaCfgAfescs u | 1576 | AGGUCGUGCCAGAAGGAAU GAGA | 1633 |
| AD-60182.1 | CfsasAfgAfaAfgGfGfA fuCfuGfuGfuGfgCfL96 | 1520 | gsCfscAfcAfcAfgAfuccCfuUfuCfuUfgsus c | 1577 | GACAAGAAAGGGAUCUGUG UGGC | 1634 |
| AD-60203.1 | CfsusGfuGfcAfaGfAfC fuUfcCfuAfaAfgAfL96 | 1521 | usCfsuUfuAfgGfaAfgucUfuGfcAfcAfgsus g | 1578 | CACUGUGCAAGACUUCCUAA AGA | 1635 |
| AD-60157.1 | CfsscsAfgAfuCfcAfCfU fuCfaCfcAfaGfaFfL96 | 1522 | usUfscUfuGfgUfgAfaguGfaUfcUfgGfusas a | 1579 | UACCAGAUCCACUUCACCAA GAC | 1636 |
| AD-60192.1 | GfscsUfgCfuGfaAfAfG faCfuUfuGfaCfuFfL96 | 1523 | gsAfsgUfcAfaAfgUfcuuUfcAfgCfaGfcsas g | 1580 | CUGCUGCUGAAAGACUUUG ACUC | 1637 |

TABLE 8

C3 single dose screen in Hep3B Cells

| Duplex name | 10 nM Avg | 10 nM SD | 0.1 nM Avg | 0.1 nM SD |
|---|---|---|---|---|
| AD-60165.1 | 5.54 | 0.43 | 13.05 | 2.69 |
| AD-60153.1 | 20.13 | 22.87 | 22.40 | 3.76 |
| AD-60175.1 | 24.94 | 4.74 | 42.14 | 7.68 |
| AD-60169.1 | 10.66 | 6.66 | 49.63 | 17.36 |
| AD-60187.1 | 9.49 | 3.28 | 51.15 | 11.65 |
| AD-60149.1 | 7.49 | 7.75 | 55.90 | 4.41 |
| AD-60171.1 | 23.77 | 7.94 | 60.35 | 7.27 |
| AD-60160.1 | 11.49 | 4.68 | 60.48 | 11.60 |
| AD-60206.1 | 45.64 | 41.01 | 63.62 | 9.90 |
| AD-60176.1 | 17.30 | 8.83 | 66.19 | 13.81 |
| AD-60156.1 | 18.22 | 0.80 | 66.39 | 1.67 |
| AD-60155.1 | 20.48 | 2.10 | 68.97 | 1.73 |
| AD-60183.1 | 13.82 | 8.64 | 69.24 | 3.35 |
| AD-60161.1 | 27.49 | 10.88 | 80.57 | 16.13 |
| AD-60166.1 | 35.21 | 21.31 | 81.66 | 14.48 |
| AD-60201.1 | 24.60 | 10.68 | 83.80 | 4.87 |
| AD-60179.1 | 15.21 | 3.55 | 85.30 | 23.07 |
| AD-60164.1 | 33.93 | 4.07 | 85.93 | 1.00 |
| AD-60186.1 | 72.24 | 6.37 | 88.39 | 51.31 |
| AD-60162.1 | 49.58 | 3.76 | 89.22 | 6.06 |
| AD-60189.1 | 52.59 | 4.25 | 89.41 | 20.79 |
| AD-60178.1 | 22.65 | 5.82 | 90.84 | 15.23 |
| AD-60194.1 | 37.79 | 4.71 | 91.29 | 7.32 |
| AD-60199.1 | 21.84 | 3.46 | 91.78 | 7.69 |
| AD-60174.1 | 16.68 | 0.45 | 92.68 | 45.25 |
| AD-60159.1 | 27.58 | 4.77 | 92.91 | 2.22 |
| AD-60168.1 | 26.91 | 2.50 | 92.99 | 5.86 |
| AD-60198.1 | 84.91 | 36.10 | 93.04 | 7.23 |
| AD-60180.1 | 45.91 | 16.19 | 93.35 | 28.54 |
| AD-60190.1 | 16.67 | 1.22 | 95.38 | 11.83 |
| AD-60188.1 | 55.44 | 7.05 | 95.66 | 30.36 |
| AD-60205.1 | 80.10 | 32.44 | 96.81 | 19.27 |
| AD-60184.1 | 26.47 | 9.64 | 97.94 | 9.88 |
| AD-60163.1 | 91.18 | 5.14 | 99.19 | 21.40 |
| AD-60172.1 | 143.57 | 8.09 | 99.22 | 11.58 |
| AD-60151.1 | 24.05 | 14.22 | 101.65 | 8.27 |
| AD-60196.1 | 67.05 | 1.31 | 102.53 | 11.85 |
| AD-60204.1 | 78.88 | 5.99 | 103.20 | 7.01 |
| AD-60185.1 | 41.42 | 7.77 | 103.45 | 2.47 |
| AD-60170.1 | 52.73 | 2.71 | 104.43 | 22.03 |
| AD-60158.1 | 81.03 | 14.03 | 105.18 | 14.20 |
| AD-60200.1 | 119.02 | 22.61 | 106.55 | 15.55 |
| AD-60173.1 | 100.25 | 12.25 | 108.80 | 44.49 |
| AD-60181.1 | 63.50 | 10.07 | 109.82 | 14.56 |
| AD-60152.1 | 16.58 | 10.66 | 112.51 | 19.82 |
| AD-60197.1 | 96.07 | 21.94 | 112.70 | 27.14 |
| AD-60191.1 | 101.85 | 48.90 | 112.76 | 8.49 |
| AD-60154.1 | 24.21 | 8.93 | 112.90 | 25.58 |
| AD-60167.1 | 106.64 | 8.09 | 115.02 | 39.17 |
| AD-60177.1 | 50.71 | 20.19 | 116.18 | 1.49 |
| AD-60195.1 | 128.54 | 29.35 | 116.68 | 11.92 |
| AD-60193.1 | 84.93 | 4.99 | 117.62 | 3.53 |
| AD-60202.1 | 90.00 | 20.98 | 119.83 | 16.90 |
| AD-60182.1 | 110.82 | 1.09 | 121.62 | 6.78 |
| AD-60203.1 | 75.57 | 6.66 | 125.15 | 34.15 |
| AD-60157.1 | 29.07 | 5.80 | 125.72 | 8.08 |
| AD-60192.1 | 83.74 | 7.99 | 141.55 | 1.82 |

Example 3. In Vivo Activity

In order to determine the in vivo efficacy of the agents, wild-type (C57BL/6) mice (n=3) were subcutaneously administered a single 1 mg/kg, 3 mg/kg, 5 mg/kg, or 10 mg/kg dose of AD-80806; or a single 1 mg/kg, 3 mg/kg, 5 mg/kg, 10 mg/kg, or 20 mg/kg dose of AD-80807; or PBS as a control. At day 7 post-dose, animals were sacrificed, liver samples were collected and the liver level of C3 mRNA was determined by QRT-PCR. The modified sense and antisense strand nucleotide sequences of AD-80806 and AD-80807 are shown in Table 9 below:

TABLE 9

| Duplex ID | Sense (5' to 3') | SEQ ID NO: | Antisense (5' to 3') | SEQ ID NO: |
|---|---|---|---|---|
| AD-80806 | asascaagAfaGfAfAfcaaacucacaL96 | 1638 | usGfsugaGfuuuguucUfuCfuuguuscsa | 1640 |
| AD-80807 | csgsugacAfgUfGfGfuggcaaacuuL96 | 1639 | asAfsguuUfgccaccaCfuGfucacgsusa | 1641 |

As shown in Table 10A, which provides the relative levels of C3 mRNA in mouse livers, with respect to the level of C3 in the livers of PBS-injected mice, both AD-80806 and AD-80807 effectively knock down C3 mRNA at all doses tested.

The in vivo efficacy of AD-80806 and AD-80807 was also assessed in Sprague-Dawley (wild-type) rats. In particular, rats (n=3) were subcutaneously administered a single 1 mg/kg, 3 mg/kg, 5 mg/kg, or 10 mg/kg dose of AD-80806; or a single 1 mg/kg, 3 mg/kg, 5 mg/kg, or 10 mg/kg dose of AD-80807; or PBS as a control. At day 7 post-dose, animals were sacrificed and the liver level of C3 mRNA was determined by QRT-PCR. As shown in Table 10B, which provides the levels of C3 in rat livers, relative to the level of C3 in the livers of PBS-injected rats, a single 10 mg/kg dose of AD-80806 effectively knocks down C3 mRNA.

In separate studies, the in vivo efficacy of AD-80806 was also assessed in Sprague-Dawley (wild-type) rats. In particular, rats (n=5) were subcutaneously administered a single 15 mg/kg dose of AD-80806; or PBS as a control. At day 11 post-dose, animals were sacrificed and the liver level of C3 mRNA was determined by QRT-PCR. As shown in Table 10C, a single 15 mg/kg dose of AD-80806 effectively knocks down C3 mRNA levels.

TABLE 10A

In vivo C3 single dose screen in wild-type mice

| Species | Strain | Dosing regimen | Duplex ID | Dose Conc | N | C3 mRNA remaining Avg | C3 mRNA remaining Stdev | C3 Knockdown |
|---|---|---|---|---|---|---|---|---|
| Mouse | WT (C57Bl/6) | Single | AD-80806 | 1 mg/kg | 3 | 20.1% | 4.1% | 79.9% |
| | | | | 3 mg/kg | 3 | 13.7% | 8.3% | 86.3% |
| | | | | 5 mg/kg | 3 | 3.9% | 3.0% | 96.1% |
| | | | | 10 mg/kg | 3 | 2.1% | 0.4% | 97.9% |

TABLE 10A-continued

In vivo C3 single dose screen in wild-type mice

| Species | Strain | Dosing regimen | Duplex ID | Dose Conc | N | C3 mRNA remaining Avg | Stdev | C3 Knockdown |
|---|---|---|---|---|---|---|---|---|
| | | | AD-80807 | 1 mg/kg | 3 | 37.7% | 22.5% | 62.3% |
| | | | | 3 mg/kg | 3 | 17.3% | 12.1% | 82.7% |
| | | | | 5 mg/kg | 3 | 5.1% | 2.4% | 94.9% |
| | | | | 10 mg/kg | 3 | 11.6% | 14.4% | 88.4% |
| | | | | 20 mg/kg | 3 | 2.3% | 2.1% | 97.7% |
| | | | PBS | Control | 3 | 100.0% | 14.0% | |

TABLE 10B

In vivo C3 single dose screen in wild-type rats

| Species | Strain | Dosing regimen | Duplex ID | Dose Conc | N | C3 mRNA remaining Avg | Stdev | C3 Knockdown |
|---|---|---|---|---|---|---|---|---|
| Rat | WT (Sprague-Dawley) | Single | AD-80806 | 1 mg/kg | 3 | 84.16% | 17.8% | 15.8% |
| | | | | 3 mg/kg | 3 | 79.58% | 22.9% | 20.4% |
| | | | | 5 mg/kg | 3 | 66.02% | 3.7% | 34.0% |
| | | | | 10 mg/kg | 3 | 38.14% | 1.4% | 61.9% |
| | | | AD-80807 | 1 mg/kg | 3 | 98.56% | 9.8% | 1.4% |
| | | | | 3 mg/kg | 3 | 73.62% | 2.0% | 26.4% |
| | | | | 5 mg/kg | 3 | 62.78% | 14.7% | 37.2% |
| | | | | 10 mg/kg | 3 | 55.28% | 7.4% | 44.7% |
| | | | PBS | Control | 3 | 100.00% | 18.7% | |

TABLE 10C

In vivo C3 single dose screen in wild-type rats

| Species | Strain | Dosing regimen | Duplex ID | Dose Conc | N | C3 mRNA remaining Avg | Stdev | C3 Knockdown |
|---|---|---|---|---|---|---|---|---|
| Rat | WT (Sprague-Dawley) | Single | AD-80806 | 15 mg/kg | 5 | 11.00% | 6.0% | 89.0% |
| | | | PBS | Control | 5 | 100.00% | 5.0% | |
| Rat | WT (Sprague-Dawley) | Single | AD-80806 | 15 mg/kg | 5 | 11.00% | 3.0% | 89.0% |
| | | | PBS | Control | 5 | 100.00% | 10.0% | |
| Mouse | Lupus model (MRL/lpr) | Multiple q3W | AD-80806 | 10 mg/kg | 10 | 2.00% | 0.3% | 98.0% |
| | | | PBS | Control | 10 | 100.00% | 27.0% | |

Example 4. Efficacy of Multiple Doses of AD-80806 in an Animal Model of Systemic Lupus Erythematosus The efficacy of multiple doses of AD-80806 was assessed in an art-recognized animal model of systemic lupus erythematosus, MRL/lpr mice. Specifically, at day 0, 8-week old animals were subcutaneously administered a 10 mg/kg dose of AD-80806 (n=10); or PBS (n=16) as a control, and subsequently administered additional 10 mg/kg doses of AD-80806 every three weeks (q3w) thereafter for a total of 17 weeks. At day 119, animals were sacrificed and the serum level of C3 mRNA was determined by QRT-PCR. Serum samples were also collected retrorbitally at 8 weeks (pre-first dose), 11 weeks, 14 weeks, 17 weeks, and 25 weeks of age and the level of serum C3 protein was determined using an ELISA assay. In addition, spot urine was collected at 7 weeks (pre-dose), 11 weeks, 16 weeks, 20 weeks, and 25 weeks of age and the levels of urine albumin and urine creatinine were determined. Seventeen weeks after the initiation of treatment (at 25 weeks of age) or if the animal reached a humane endpoint prior to the end of the study, animals were sacrificed and tissues and serum were harvested for qPCR and complement activity assessment.

Tables 11A and 11B demonstrate that a multi-dose 10 mg/kg regimen of AD-80806 efficaciously knocks down C3 mRNA in the liver and C3 protein in serum; at the end of the study, an average of only 2% of the C3 transcript remained in the liver of the treated animals, when compared to C3 levels in PBS-injected mice, whereas 5.8% of protein remained in circulation in the serum compared to PBS treated animals. Consistent with the reduction in C3 protein levels a significant reduction in the complement alternative pathway activity as measured by a rabbit erythrocyte hemolysis assay was observed with AD-80806 treatment relative to PBS treated animals (Table 11F). Tables 11C and 11D demonstrate that a multi-dose 10 mg/kg administration of AD-80806 at three-week intervals reduced the levels of urinary albumin (Table 11C) and urinary creatinine (Table 11D).

Furthermore, although there was no significant reduction in the urine albumin to urine creatine ratio (indicative of microalbumineria in these animals) (Table 11E), there was a significant decrease in the alternative pathway hemolytic activity (AH50) in the serum as determined by a rabbit erythrocyte assay (Table 11F) in animals receiving a multi-dose 10 mg/kg regimen of AD-80806 for 17 weeks. Furthermore, there was significant increase in survival of the animals (Table 11G). Indeed, at day 105, 90% of the animals that were administered AD-80806 at three-week intervals had survived, while only 56.3% of the control animals had survived.

In addition, histopathological analyses of the kidneys of these animals demonstrate that there were significantly fewer pathological changes in the glomeruli and tubules of the MRL/lpr mice receiving the q3w regimen of AD-80806 as compared to controls (Tables 11H and 11I).

TABLE 11A

In vivo C3 Multi-Dose Treatment in MRL/lpr Mice

| Species | Strain | Dosing regimen | Duplex ID | Dose Conc | N | C3 mRNA remaining Avg | Stdev | C3 Knockdown |
|---|---|---|---|---|---|---|---|---|
| Mouse | Lupus model (MRL/lpr) | Multiple q3W | AD-80806 | 10 mg/kg | 10 | 2.00% | 0.3% | 98.0% |
| | | | PBS | Control | 16 | 100.00% | 27.0% | |

TABLE 11B

C3 Protein Levels in MRL/lpr Mice

| Duplex ID | Dose Conc | N | C3 protein remaining (normalized to Day 0 values) | | | | |
|---|---|---|---|---|---|---|---|
| | | | Day 0 Average | Day 21 Average | Day 42 Average | Day 63 Average | Day 111 Average |
| AD-80806 | 10 mg/kg | 10 | 100.0% | 21.8% | 13.9% | 9.9% | 5.8% |
| PBS | Control | 16 | 100.0% | 108.2% | 71.4% | 66.9% | 66.4% |

TABLE 11C

Urine Albumin Levels in MRL/lpr Mice

| Duplex ID | Dose Conc | N | Urine Albumin levels (ug/mL) | | | | |
|---|---|---|---|---|---|---|---|
| | | | Day 0 Average | Day 21 Average | Day 42 Average | Day 63 Average | Day 111 Average |
| AD-80806 | 10 mg/kg | 10 | 3.95 | 33.50 | 173.65 | 160.04 | 208.61 |
| PBS | Control | 16 | 2.01 | 136.33 | 273.14 | 263.60 | 293.66 |

TABLE 11D

Urine Creatinine Levels in MRL/lpr Mice

| Duplex ID | Dose Conc | N | Urine Creatinine levels (ug/mL) | | | | |
|---|---|---|---|---|---|---|---|
| | | | Day 0 Average | Day 21 Average | Day 42 Average | Day 63 Average | Day 111 Average |
| AD-80806 | 10 mg/kg | 10 | 202.25 | 239.80 | 214.20 | 120.17 | 129.05 |
| PBS | Control | 16 | 237.17 | 221.46 | 275.17 | 137.42 | 170.37 |

TABLE 11E

Urine Albumin to Creatinine Ratio in MRL/lpr Mice

| Duplex ID | Dose Conc | N | Day 0 | Urine Albumin to Creatinine ratio | | | |
|---|---|---|---|---|---|---|---|
| | | | | Day 21 Average | Day 42 Average | Day 63 Average | Day 111 Average |
| AD-80806 | 10 mg/kg | 10 | 0.02 | 0.14 | 0.89 | 1.51 | 3.11 |
| PBS | Control | 16 | 0.01 | 0.51 | 0.98 | 2.00 | 3.11 |

TABLE 11F

Alternative Complement Hemolytic Activity

| Duplex ID | Dose Conc | N | % Hemolysis (Normalized to controls) | |
|---|---|---|---|---|
| | | | Average | Stdev |
| AD-80806 | 10 mg/kg | 10 | 19.3% | 12.9% |
| PBS | Control | 16 | 52.4% | 15.4% |

TABLE 11G

Survival

| Duplex ID | Dose Conc | N | Survival Curve | | | | |
|---|---|---|---|---|---|---|---|
| | | | Day 0 | Day 42 | Day 49 | Day 70 | Day 105 |
| AD-80806 | 10 mg/kg | 10 | 100.0% | 100.0% | 90.0% | 90.0% | 90.0% |
| PBS | Control | 16 | 100.0% | 87.5% | 75.0% | 62.5% | 56.3% |

TABLE 11H

Kidney Histology-Glomerulonephritis Score

| Duplex ID | Dose Conc | N | Glomerulopathy Score (0 = Normal 4 = Severe, % in each grade) | | | | |
|---|---|---|---|---|---|---|---|
| | | | Grade 0 | Grade 1 | Grade 2 | Grade 3 | Grade 4 |
| AD-80806 | 10 mg/kg | 10 | 0.0% | 0.0% | 50.0% | 40.0% | 10.0% |
| PBS | Control | 16 | 0.0% | 0.0% | 25.0% | 18.8% | 56.3% |

TABLE 11I

Kidney Histology-Tubular Change Score

| Duplex ID | Dose Conc | N | Tubular Score (0 = Normal 4 = Severe, % in each grade) | | | | |
|---|---|---|---|---|---|---|---|
| | | | Grade 0 | Grade 1 | Grade 2 | Grade 3 | Grade 4 |
| AD-80806 | 10 mg/kg | 10 | 30.0% | 30.0% | 30.0% | 0.0% | 10.0% |
| PBS | Control | 16 | 0.0% | 25.0% | 18.8% | 12.5% | 43.8% |

EQUIVALENTS

As may be recognized by those of ordinary skill in the pertinent art based on the teachings herein, numerous changes and modifications may be made to the above-described and other embodiments of the present disclosure without departing from the spirit of the invention as defined in the appended claims. Accordingly, this detailed description of embodiments is to be taken in an illustrative, as opposed to a limiting, sense. Those skilled in the art will recognize, or be able to ascertain using no more than routine experimentation, many equivalents to the specific embodiments of the described herein. Such equivalents are intended to be encompassed by the following claims.

```
>gi|726965399|ref|NM_000064.3| Homo sapiens complement component 3 (C3),
mRNA
                                                                SEQ ID NO: 1
AGATAAAAAGCCAGCTCCAGCAGGCGCTGCTCACTCCTCCCCATCCTCTCCCTCTGTCCCTCTGTCCCTC

TGACCCTGCACTGTCCCAGCACCATGGGACCCACCTCAGGTCCCAGCCTGCTGCTCCTGCTACTAACCCA

CCTCCCCCTGGCTCTGGGGAGTCCCATGTACTCTATCATCACCCCCAACATCTTGCGGCTGGAGAGCGAG

GAGACCATGGTGCTGGAGGCCCACGACGCGCAAGGGGATGTTCCAGTCACTGTTACTGTCCACGACTTCC

CAGGCAAAAAACTAGTGCTGTCCAGTGAGAAGACTGTGCTGACCCCTGCCACCAACCACATGGGCAACGT

CACCTTCACGATCCCAGCCAACAGGGAGTTCAAGTCAGAAAAGGGGCGCAACAAGTTCGTGACCGTGCAG

GCCACCTTCGGGACCCAAGTGGTGGAGAAGGTGGTGCTGGTCAGCCTGCAGAGCGGGTACCTCTTCATCC

AGACAGACAAGACCATCTACACCCCTGGCTCCACAGTTCTCTATCGGATCTTCACCGTCAACCACAAGCT

GCTACCCGTGGGCCGGACGGTCATGGTCAACATTGAGAACCCGGAAGGCATCCCGGTCAAGCAGGACTCC

TTGTCTTCTCAGAACCAGCTTGGCGTCTTGCCCTTGTCTTGGGACATTCCGGAACTCGTCAACATGGGCC

AGTGGAAGATCCGAGCCTACTATGAAAACTCACCACAGCAGGTCTTCTCCACTGAGTTTGAGGTGAAGGA

GTACGTGCTGCCCAGTTTCGAGGTCATAGTGGAGCCTACAGAGAAATTCTACTACATCTATAACGAGAAG

GGCCTGGAGGTCACCATCACCGCCAGGTTCCTCTACGGGAAGAAAGTGGAGGGAACTGCCTTTGTCATCT

TCGGGATCCAGGATGGCGAACAGAGGATTTCCCTGCCTGAATCCCTCAAGCGCATTCCGATTGAGGATGG

CTCGGGGGAGGTTGTGCTGAGCCGGAAGGTACTGCTGGACGGGGTGCAGAACCCCCGAGCAGAAGACCTG

GTGGGGAAGTCTTTGTACGTGTCTGCCACCGTCATCTTGCACTCAGGCAGTGACATGGTGCAGGCAGAGC

GCAGCGGGATCCCCATCGTGACCTCTCCCTACCAGATCCACTTCACCAAGACACCCAAGTACTTCAAACC

AGGAATGCCCTTTGACCTCATGGTGTTCGTGACGAACCCTGATGGCTCTCCAGCCTACCGAGTCCCCGTG

GCAGTCCAGGGCGAGGACACTGTGCAGTCTCTAACCCAGGGAGATGGCGTGGCCAAACTCAGCATCAACA

CACACCCCAGCCAGAAGCCCTTGAGCATCACGGTGCGCACGAAGAAGCAGGAGCTCTCGGAGGCAGAGCA

GGCTACCAGGACCATGCAGGCTCTGCCCTACAGCACCGTGGGCAACTCCAACAATTACCTGCATCTCTCA

GTGCTACGTACAGAGCTCAGACCCGGGGAGACCCTCAACGTCAACTTCCTCCTGCGAATGGACCGCGCCC

ACGAGGCCAAGATCCGCTACTACACCTACCTGATCATGAACAAGGGCAGGCTGTTGAAGGCGGGACGCCA

GGTGCGAGAGCCCGGCCAGGACCTGGTGGTGCTGCCCCTGTCCATCACCACCGACTTCATCCCTTCCTTC

CGCCTGGTGGCGTACTACACGCTGATCGGTGCCAGCGGCCAGAGGGAGGTGGTGGCCGACTCCGTGTGGG

TGGACGTCAAGGACTCCTGCGTGGGCTCGCTGGTGGTAAAAAGCGGCCAGTCAGAAGACCGGCAGCCTGT

ACCTGGGCAGCAGATGACCCTGAAGATAGAGGGTGACCACGGGGCCCGGGTGGTACTGGTGGCCGTGGAC

AAGGGCGTGTTCGTGCTGAATAAGAAGAACAAACTGACGCAGAGTAAGATCTGGGACGTGGTGGAGAAGG

CAGACATCGGCTGCACCCCGGGCAGTGGGAAGGATTACGCCGGTGTCTTCTCCGACGCAGGGCTGACCTT

CACGAGCAGCAGTGGCCAGCAGACCGCCCAGAGGGCAGAACTTCAGTGCCCGCAGCCAGCCGCCCGCCGA

CGCCGTTCCGTGCAGCTCACGGAGAAGCGAATGGACAAAGTCGGCAAGTACCCCAAGGAGCTGCGCAAGT

GCTGCGAGGACGGCATGCGGGAGAACCCCATGAGGTTCTCGTGCCAGCGCCGGACCCGTTTCATCTCCCT

GGGCGAGGCGTGCAAGAAGGTCTTCCTGGACTGCTGCAACTACATCACAGAGCTGCGGCGGCAGCACGCG

CGGGCCAGCCACCTGGGCCTGGCCAGGAGTAACCTGGATGAGGACATCATTGCAGAAGAGAACATCGTTT
```

-continued

```
CCCGAAGTGAGTTCCCAGAGAGCTGGCTGTGGAACGTTGAGGACTTGAAAGAGCCACCGAAAAATGGAAT
CTCTACGAAGCTCATGAATATATTTTTGAAAGACTCCATCACCACGTGGGAGATTCTGGCTGTGAGCATG
TCGGACAAGAAAGGGATCTGTGTGGCAGACCCCTTCGAGGTCACAGTAATGCAGGACTTCTTCATCGACC
TGCGGCTACCCTACTCTGTTGTTCGAAACGAGCAGGTGGAAATCCGAGCCGTTCTCTACAATTACCGGCA
GAACCAAGAGCTCAAGGTGAGGGTGGAACTACTCCACAATCCAGCCTTCTGCAGCCTGGCCACCACCAAG
AGGCGTCACCAGCAGACCGTAACCATCCCCCCCAAGTCCTCGTTGTCCGTTCCATATGTCATCGTGCCGC
TAAAGACCGGCCTGCAGGAAGTGGAAGTCAAGGCTGCTGTCTACCATCATTTCATCAGTGACGGTGTCAG
GAAGTCCCTGAAGGTCGTGCCGGAAGGAATCAGAATGAACAAAACTGTGGCTGTTCGCACCCTGGATCCA
GAACGCCTGGGCCGTGAAGGAGTGCAGAAAGAGGACATCCCACCTGCAGACCTCAGTGACCAAGTCCCGG
ACACCGAGTCTGAGACCAGAATTCTCCTGCAAGGGACCCCAGTGGCCCAGATGACAGAGGATGCCGTCGA
CGCGGAACGGCTGAAGCACCTCATTGTGACCCCCTCGGGCTGCGGGGAACAGAACATGATCGGCATGACG
CCCACGGTCATCGCTGTGCATTACCTGGATGAAACGGAGCAGTGGGAGAAGTTCGGCCTAGAGAAGCGGC
AGGGGGCCTTGGAGCTCATCAAGAAGGGGTACACCCAGCAGCTGGCCTTCAGACAACCCAGCTCTGCCTT
TGCGGCCTTCGTGAAACGGGCACCCAGCACCTGGCTGACCGCCTACGTGGTCAAGGTCTTCTCTCTGGCT
GTCAACCTCATCGCCATCGACTCCCAAGTCCTCTGCGGGGCTGTTAAATGGCTGATCCTGGAGAAGCAGA
AGCCCGACGGGGTCTTCCAGGAGGATGCGCCCGTGATACACCAAGAAATGATTGGTGGATTACGGAACAA
CAACGAGAAAGACATGGCCCTCACGGCCTTTGTTCTCATCTCGCTGCAGGAGGCTAAAGATATTTGCGAG
GAGCAGGTCAACAGCCTGCCAGGCAGCATCACTAAAGCAGGAGACTTCCTTGAAGCCAACTACATGAACC
TACAGAGATCCTACACTGTGGCCATTGCTGGCTATGCTCTGCCCAGATGGGCAGGCTGAAGGGGCCTCT
TCTTAACAAATTTCTGACCACAGCCAAAGATAAGAACCGCTGGGAGGACCCTGGTAAGCAGCTCTACAAC
GTGGAGGCCACATCCTATGCCCTCTTGGCCCTACTGCAGCTAAAAGACTTTGACTTTGTGCCTCCCGTCG
TGCGTTGGCTCAATGAACAGAGATACTACGGTGGTGGCTATGGCTCTACCCAGGCCACCTTCATGGTGTT
CCAAGCCTTGGCTCAATACCAAAAGGACGCCCCTGACCACCAGGAACTGAACCTTGATGTGCCCTCCAA
CTGCCCAGCCGCAGCTCCAAGATCACCCACCGTATCCACTGGGAATCTGCCAGCCTCCTGCGATCAGAAG
AGACCAAGGAAAATGAGGGTTTCACAGTCACAGCTGAAGGAAAAGGCCAAGGCACCTTGTCGGTGGTGAC
AATGTACCATGCTAAGGCCAAAGATCAACTCACCTGTAATAAATTCGACCTCAAGGTCACCATAAAACCA
GCACCGGAAACAGAAAAGAGGCCTCAGGATGCCAAGAACACTATGATCCTTGAGATCTGTACCAGGTACC
GGGGAGACCAGGATGCCACTATGTCTATATTGGACATATCCATGATGACTGGCTTTGCTCCAGACACAGA
TGACCTGAAGCAGCTGGCCAATGGTGTTGACAGATACATCTCCAAGTATGAGCTGGACAAAGCCTTCTCC
GATAGGAACACCCTCATCATCTACCTGGACAAGGTCTCACACTCTGAGGATGACTGTCTAGCTTTCAAAG
TTCACCAATACTTTAATGTAGAGCTTATCCAGCCTGGAGCAGTCAAGGTCTACGCCTATTACAACCTGGA
GGAAAGCTGTACCCGGTTCTACCATCCGGAAAAGGAGGATGGAAAGCTGAACAAGCTCTGCCGTGATGAA
CTGTGCCGCTGTGCTGAGGAGAATTGCTTCATACAAAAGTCGGATGACAAGGTCACCCTGGAAGAACGGC
TGGACAAGGCCTGTGAGCCAGGAGTGGACTATGTGTACAAGACCCGACTGGTCAAGGTTCAGCTGTCCAA
TGACTTTGACGAGTACATCATGGCCATTGAGCAGACCATCAAGTCAGGCTCGGATGAGGTGCAGGTTGGA
CAGCAGCGCACGTTCATCAGCCCCATCAAGTGCAGAGAAGCCCTGAAGCTGGAGGAGAAGAAACACTACC
TCATGTGGGGTCTCTCCTCCGATTTCTGGGGAGAGAAGCCCAACCTCAGCTACATCATCGGGAAGGACAC
TTGGGTGGAGCACTGGCCCGAGGAGGACGAATGCCAAGACGAAGAGAACCAGAAACAATGCCAGGACCTC
GGCGCCTTCACCGAGAGCATGGTTGTCTTTGGGTGCCCCAACTGACCACACCCCCATTCCCCCACTCCAG
ATAAAGCTTCAGTTATATCTCAAAAAAAAAAAAAAAAA
```

Reverse Complement of SEQ ID NO: 1
>gi|726965399|ref|NM_000064.3| *Homo sapiens* complement component 3 (C3), mRNA

SEQ ID NO: 2

AGATAAAAAGCCAGCTCCAGCAGGCGCTGCTCACTCCTCCCCATCCTCTCCCTCTGTCCCTCTGTCCCTC

TGACCCTGCACTGTCCCAGCACCATGGGACCCACCTCAGGTCCCAGCCTGCTGCTCCTGCTACTAACCCA

CCTCCCCCTGGCTCTGGGGAGTCCCATGTACTCTATCATCACCCCCAACATCTTGCGGCTGGAGAGCGAG

GAGACCATGGTGCTGGAGGCCCACGACGCGCAAGGGGATGTTCCAGTCACTGTTACTGTCCACGACTTCC

CAGGCAAAAAACTAGTGCTGTCCAGTGAGAAGACTGTGCTGACCCCTGCCACCAACCACATGGGCAACGT

CACCTTCACGATCCCAGCCAACAGGGAGTTCAAGTCAGAAAAGGGGCGCAACAAGTTCGTGACCGTGCAG

GCCACCTTCGGGACCCAAGTGGTGGAGAAGGTGGTGCTGGTCAGCCTGCAGAGCGGGTACCTCTTCATCC

AGACAGACAAGACCATCTACACCCCTGGCTCCACAGTTCTCTATCGGATCTTCACCGTCAACCACAAGCT

GCTACCCGTGGGCCGGACGGTCATGGTCAACATTGAGAACCCGGAAGGCATCCCGGTCAAGCAGGACTCC

TTGTCTTCTCAGAACCAGCTTGGCGTCTTGCCCTTGTCTTGGGACATTCCGGAACTCGTCAACATGGGCC

AGTGGAAGATCCGAGCCTACTATGAAAACTCACCACAGCAGGTCTTCTCCACTGAGTTTGAGGTGAAGGA

GTACGTGCTGCCCAGTTTCGAGGTCATAGTGGAGCCTACAGAGAAATTCTACTACATCTATAACGAGAAG

GGCCTGGAGGTCACCATCACCGCCAGGTTCCTCTACGGGAAGAAAGTGGAGGGAACTGCCTTTGTCATCT

TCGGGATCCAGGATGGCGAACAGAGGATTTCCCTGCCTGAATCCCTCAAGCGCATTCCGATTGAGGATGG

CTCGGGGGAGGTTGTGCTGAGCCGGAAGGTACTGCTGGACGGGGTGCAGAACCCCCGAGCAGAAGACCTG

GTGGGGAAGTCTTTGTACGTGTCTGCCACCGTCATCTTGCACTCAGGCAGTGACATGGTGCAGGCAGAGC

GCAGCGGGATCCCCATCGTGACCTCTCCCTACCAGATCCACTTCACCAAGACACCCAAGTACTTCAAACC

AGGAATGCCCTTTGACCTCATGGTGTTCGTGACGAACCCTGATGGCTCTCCAGCCTACCGAGTCCCCGTG

GCAGTCCAGGGCGAGGACACTGTGCAGTCTCTAACCCAGGGAGATGGCGTGGCCAAACTCAGCATCAACA

CACACCCCAGCCAGAAGCCCTTGAGCATCACGGTGCGCACGAAGAAGCAGGAGCTCTCGGAGGCAGAGCA

GGCTACCAGGACCATGCAGGCTCTGCCCTACAGCACCGTGGGCAACTCCAACAATTACCTGCATCTCTCA

GTGCTACGTACAGAGCTCAGACCCGGGGAGACCCTCAACGTCAACTTCCTCCTGCGAATGGACCGCGCCC

ACGAGGCCAAGATCCGCTACTACACCTACCTGATCATGAACAAGGGCAGGCTGTTGAAGGCGGGACGCCA

GGTGCGAGAGCCCGGCCAGGACCTGGTGGTGCTGCCCCTGTCCATCACCACCGACTTCATCCCTTCCTTC

CGCCTGGTGGCGTACTACACGCTGATCGGTGCCAGCGGCCAGAGGGAGGTGGTGGCCGACTCCGTGTGGG

TGGACGTCAAGGACTCCTGCGTGGGCTCGCTGGTGGTAAAAAGCGGCCAGTCAGAAGACCGGCAGCCTGT

ACCTGGGCAGCAGATGACCCTGAAGATAGAGGGTGACCACGGGCCCGGGTGGTACTGGTGGCCGTGGAC

AAGGGCGTGTTCGTGCTGAATAAGAAGAACAAACTGACGCAGAGTAAGATCTGGGACGTGGTGGAGAAGG

CAGACATCGGCTGCACCCCGGGCAGTGGGAAGGATTACGCCGGTGTCTTCTCCGACGCAGGGCTGACCTT

CACGAGCAGCAGTGGCCAGCAGACCGCCCAGAGGGCAGAACTTCAGTGCCCGCAGCCAGCCGCCCGCCGA

CGCCGTTCCGTGCAGCTCACGGAGAAGCGAATGGACAAAGTCGGCAAGTACCCCAAGGAGCTGCGCAAGT

GCTGCGAGGACGGCATGCGGGAGAACCCCATGAGGTTCTCGTGCCAGCGCCGGACCCGTTTCATCTCCCT

GGGCGAGGCGTGCAAGAAGGTCTTCCTGGACTGCTGCAACTACATCACAGAGCTGCGGCGGCAGCACGCG

CGGGCCAGCCACCTGGGCCTGGCCAGGAGTAACCTGGATGAGGACATCATTGCAGAAGAGAACATCGTTT

CCCGAAGTGAGTTCCCAGAGAGCTGGCTGTGGAACGTTGAGGACTTGAAAGAGCCACCGAAAAATGGAAT

CTCTACGAAGCTCATGAATATATTTTTGAAAGACTCCATCACCACGTGGGAGATTCTGGCTGTGAGCATG

TCGGACAAGAAAGGGATCTGTGTGGCAGACCCCTTCGAGGTCACAGTAATGCAGGACTTCTTCATCGACC

TGCGGCTACCCTACTCTGTTGTTCGAAACGAGCAGGTGGAAATCCGAGCCGTTCTCTACAATTACCGGCA

GAACCAAGAGCTCAAGGTGAGGGTGGAACTACTCCACAATCCAGCCTTCTGCAGCCTGGCCACCACCAAG

-continued

AGGCGTCACCAGCAGACCGTAACCATCCCCCCCAAGTCCTCGTTGTCCGTTCCATATGTCATCGTGCCGC

TAAAGACCGGCCTGCAGGAAGTGGAAGTCAAGGCTGCTGTCTACCATCATTTCATCAGTGACGGTGTCAG

GAAGTCCCTGAAGGTCGTGCCGGAAGGAATCAGAATGAACAAAACTGTGGCTGTTCGCACCCTGGATCCA

GAACGCCTGGGCCGTGAAGGAGTGCAGAAAGAGGACATCCCCACCTGCAGACCTCAGTGACCAAGTCCCGG

ACACCGAGTCTGAGACCAGAATTCTCCTGCAAGGGACCCCAGTGGCCCAGATGACAGAGGATGCCGTCGA

CGCGGAACGGCTGAAGCACCTCATTGTGACCCCCTCGGGCTGCGGGGAACAGAACATGATCGGCATGACG

CCCACGGTCATCGCTGTGCATTACCTGGATGAAACGGAGCAGTGGGAGAAGTTCGGCCTAGAGAAGCGGC

AGGGGGCCTTGGAGCTCATCAAGAAGGGGTACACCCAGCAGCTGGCCTTCAGACAACCCAGCTCTGCCTT

TGCGGCCTTCGTGAAACGGGCACCCAGCACCTGGCTGACCGCCTACGTGGTCAAGGTCTTCTCTCTGGCT

GTCAACCTCATCGCCATCGACTCCCAAGTCCTCTGCGGGGCTGTTAAATGGCTGATCCTGGAGAAGCAGA

AGCCCGACGGGGTCTTCCAGGAGGATGCGCCCGTGATACACCAAGAAATGATTGGTGGATTACGGAACAA

CAACGAGAAAGACATGGCCCTCACGGCCTTTGTTCTCATCTCGCTGCAGGAGGCTAAAGATATTTGCGAG

GAGCAGGTCAACAGCCTGCCAGGCAGCATCACTAAAGCAGGAGACTTCCTTGAAGCCAACTACATGAACC

TACAGAGATCCTACACTGTGGCCATTGCTGGCTATGCTCTGGCCCAGATGGGCAGGCTGAAGGGGCCTCT

TCTTAACAAATTTCTGACCACAGCCAAAGATAAGAACCGCTGGGAGGACCCTGGTAAGCAGCTCTACAAC

GTGGAGGCCACATCCTATGCCCTCTTGGCCCTACTGCAGCTAAAAGACTTTGACTTTGTGCCTCCCGTCG

TGCGTTGGCTCAATGAACAGAGATACTACGGTGGTGGCTATGGCTCTACCCAGGCCACCTTCATGGTGTT

CCAAGCCTTGGCTCAATACCAAAAGGACGCCCCTGACCACCAGGAACTGAACCTTGATGTGTCCCTCCAA

CTGCCCAGCCGCAGCTCCAAGATCACCCACCGTATCCACTGGGAATCTGCCAGCCTCCTGCGATCAGAAG

AGACCAAGGAAAATGAGGGTTTCACAGTCACAGCTGAAGGAAAAGGCCAAGGCACCTTGTCGGTGGTGAC

AATGTACCATGCTAAGGCCAAAGATCAACTCACCTGTAATAAATTCGACCTCAAGGTCACCATAAAACCA

GCACCGGAAACAGAAAAGAGGCCTCAGGATGCCAAGAACACTATGATCCTTGAGATCTGTACCAGGTACC

GGGGAGACCAGGATGCCACTATGTCTATATTGGACATATCCATGATGACTGGCTTTGCTCCAGACACAGA

TGACCTGAAGCAGCTGGCCAATGGTGTTGACAGATACATCTCCAAGTATGAGCTGGACAAAGCCTTCTCC

GATAGGAACACCCTCATCATCTACCTGGACAAGGTCTCACACTCTGAGGATGACTGTCTAGCTTTCAAAG

TTCACCAATACTTTAATGTAGAGCTTATCCAGCCTGGAGCAGTCAAGGTCTACGCCTATTACAACCTGGA

GGAAAGCTGTACCCGGTTCTACCATCCGGAAAAGGAGGATGAAAGCTGAACAAGCTCTGCCGTGATGAA

CTGTGCCGCTGTGCTGAGGAGAATTGCTTCATACAAAAGTCGGATGACAAGGTCACCCTGGAAGAACGGC

TGGACAAGGCCTGTGAGCCAGGAGTGGACTATGTGTACAAGACCCGACTGGTCAAGGTTCAGCTGTCCAA

TGACTTTGACGAGTACATCATGGCCATTGAGCAGACCATCAAGTCAGGCTCGGATGAGGTGCAGGTTGGA

CAGCAGCGCACGTTCATCAGCCCCATCAAGTGCAGAGAAGCCCTGAAGCTGGAGGAGAAGAAACACTACC

TCATGTGGGGTCTCTCCTCCGATTTCTGGGGAGAGAAGCCCAACCTCAGCTACATCATCGGGAAGGACAC

TTGGGTGGAGCACTGGCCCGAGGAGGACGAATGCCAAGACGAAGAGAACCAGAAACAATGCCAGGACCTC

GGCGCCTTCACCGAGAGCATGGTTGTCTTTGGGTGCCCCAACTGACCACACCCCATTCCCCACTCCAG

ATAAAGCTTCAGTTATATCTCAAAAAAAAAAAAAAAAA

>gi|773669943|ref|NM_009778.3| *Mus musculus* complement component 3 (C3), mRNA

SEQ ID NO: 3

AGAGAGGAGAGCCATATAAAGAGCCAGCGGCTACAGCCCCAGCTCGCCTCTGCCCACCCCTGCCCCTTAC

CCCTTCATTCCTTCCACCTTTTTCCTTCACTATGGGACCAGCTTCAGGGTCCCAGCTACTAGTGCTACTG

-continued

```
CTGCTGTTGGCCAGCTCCCCATTAGCTCTGGGGATCCCCATGTATTCCATCATTACTCCCAATGTCCTAC
GGCTGGAGAGCGAAGAGACCATCGTACTGGAGGCCCACGATGCTCAGGGTGACATCCCAGTCACAGTCAC
TGTGCAAGACTTCCTAAAGAGGCAAGTGCTGACCAGTGAGAAGACAGTGTTGACAGGAGCCAGTGGACAT
CTGAGAAGCGTCTCCATCAAGATTCCAGCCAGTAAGGAATTCAACTCAGATAAGGAGGGCACAAGTACG
TGACAGTGGTGGCAAACTTCGGGGAAACGGTGGTGGAGAAAGCAGTGATGGTAAGCTTCCAGAGTGGGTA
CCTCTTCATCCAGACAGACAAGACCATCTACACCCCTGGCTCCACTGTCTTATATCGGATCTTCACTGTG
GACAACAACCTACTGCCCGTGGGCAAGACAGTCGTCATCCTCATTGAGACCCCCGATGGCATTCCTGTCA
AGAGAGACATTCTGTCTTCCAACAACCAACACGGCATCTTGCCTTTGTCTTGGAACATTCCTGAACTGGT
CAACATGGGGCAGTGGAAGATCCGAGCCTTTTACGAACATGCGCCGAAGCAGATCTTCTCCGCAGAGTTT
GAGGTGAAGGAATACGTGCTGCCCAGTTTTGAGGTCCGGGTGGAGCCCACAGAGACATTTTATTACATCG
ATGACCCAAATGGCCTGGAAGTTTCCATCATAGCCAAGTTCCTGTACGGGAAAAACGTGGACGGGACAGC
CTTCGTGATTTTTGGGGTCCAGGATGGCGATAAGAAGATTTCTCTGGCCCACTCCCTCACGCGCGTAGTG
ATTGAGGATGGTGTGGGGGATGCAGTGCTGACCCGGAAGGTGCTGATGGAGGGGGTACGGCCTTCCAACG
CCGACGCCCTGGTGGGGAAGTCCCTGTATGTCTCCGTCACTGTCATCCTGCACTCAGGTAGTGACATGGT
AGAGGCAGAGCGCAGTGGGATCCCGATTGTCACTTCCCCGTACCAGATCCACTTCACCAAGACACCCAAA
TTCTTCAAGCCAGCCATGCCCTTTGACCTCATGGTGTTCGTGACCAACCCCGATGGCTCTCCGGCCAGCA
AAGTGCTGGTGGTCACTCAGGGATCTAATGCAAAGGCTCTCACCCAAGATGATGGCGTGGCCAAGCTAAG
CATCAACACACCCAACAGCCGCCAACCCCTGACCATCACAGTCCGCACCAAGAAGGACACTCTCCCAGAA
TCACGGCAGGCCACCAAGACAATGGAGGCCCATCCCTACAGCACTATGCACAACTCCAACAACTACCTAC
ACTTGTCAGTGTCACGAATGGAGCTCAAGCCGGGGGACAACCTCAATGTCAACTTCCACCTGCGCACAGA
CCCAGGCCATGAGGCCAAGATCCGATACTACACCTACCTGGTTATGAACAAGGGGAAGCTCCTGAAGGCA
GGCCGCCAGGTTCGGGAGCCTGGCCAGGACCTGGTGGTCTTGTCCCTGCCCATCACTCCAGAGTTTATTC
CTTCATTTCGCCTGGTGGCTTACTACACCCTGATTGGAGCTAGTGGCCAGAGGGAGGTGGTGGCTGACTC
TGTGTGGGTGGATGTGAAGGATTCCTGTATTGGCACGCTGGTGGTGAAGGGTGACCCAAGAGATAACCAT
CTCGCACCTGGGCAACAAACGACACTCAGGATTGAAGGAAACCAGGGGGCCCGAGTGGGGCTAGTGGCTG
TGGACAAGGGAGTGTTTGTGCTGAACAAGAAGAACAAACTCACACAGAGCAAGATCTGGGATGTGGTAGA
GAAGGCAGACATTGGCTGCACCCCAGGCAGTGGGAAGAACTATGCTGGTGTCTTCATGGATGCAGGCCTG
GCCTTCAAGACAAGCCAAGGACTGCAGACTGAACAGAGAGCAGATCTTGAGTGCACCAAGCCAGCAGCCC
GCCGCCGTCGCTCAGTACAGTTGATGGAAAGAAGGATGGACAAAGCTGGTCAGTACACTGACAAGGGTCT
TCGGAAGTGTTGTGAGGATGGTATGCGGGATATCCCTATGAGATACAGCTGCCAGCGCCGGGCACGCCTC
ATCACCCAGGGCGAGAACTGCATAAAGGCCTTCATAGACTGCTGCAACCACATCACCAAGCTGCGTGAAC
AACACAGAAGAGACCACGTGCTGGGCCTGGCCAGGAGTGAATTGGAGGAAGACATAATTCCAGAAGAAGA
TATTATCTCTAGAAGCCACTTCCCACAGAGCTGGTTGTGGACCATAGAAGAGTTGAAAGAACCAGAGAAA
AATGGAATCTCTACGAAGGTCATGAACATCTTTCTCAAAGATTCCATCACCACCTGGGAGATTCTGGCAG
TGAGCTTGTCAGACAAGAAAGGGATCTGTGTGGCAGACCCCTATGAGATCAGAGTGATGCAGGACTTCTT
CATTGACCTGCGGCTGCCCTACTCTGTAGTGCGCAACGAACAGGTGGAGATCAGAGCTGTGCTCTTCAAC
TACCGTGAACAGGAGGAACTTAAGGTGAGGGTGGAACTGTTGCATAATCCAGCCTTCTGCAGCATGGCCA
CCGCCAAGAATCGCTACTTCCAGACCATCAAAATCCCTCCCAAGTCCTCGGTGGCTGTACCGTATGTCAT
TGTCCCCTTGAAGATCGGCCAACAAGAGGTGGAGGTCAAGGCTGCTGTCTTCAATCACTTCATCAGTGAT
GGTGTCAAGAAGACACTGAAGGTCGTGCCAGAAGGAATGAGAATCAACAAAACTGTGGCCATCCATACAC
TGGACCCAGAGAAGCTCGGTCAAGGGGGAGTGCAGAAGGTGGATGTGCCTGCCGCAGACCTTAGCGACCA
```

-continued

```
AGTGCCAGACACAGACTCTGAGACCAGAATTATCCTGCAAGGGAGCCCGGTGGTTCAGATGGCTGAAGAT

GCTGTGGACGGGGAGCGGCTGAAACACCTGATCGTGACCCCCGCAGGCTGTGGGGAACAGAACATGATTG

GCATGACACCAACAGTCATTGCGGTACACTACCTGGACCAGACCGAACAGTGGGAGAAGTTCGGCATAGA

GAAGAGGCAAGAGGCCCTGGAGCTCATCAAGAAAGGGTACACCCAGCAGCTGGCCTTCAAACAGCCCAGC

TCTGCCTATGCTGCCTTCAACAACCGGCCCCCCAGCACCTGGCTGACAGCCTACGTGGTCAAGGTCTTCT

CTCTAGCTGCCAACCTCATCGCCATCGACTCTCACGTCCTGTGTGGGGCTGTTAAATGGTTGATTCTGGA

GAAACAGAAGCCGGATGGTGTCTTTCAGGAGGATGGGCCCGTGATTCACCAAGAAATGATTGGTGGCTTC

CGGAACGCCAAGGAGGCAGATGTGTCACTCACAGCCTTCGTCCTCATCGCACTGCAGGAAGCCAGGGACA

TCTGTGAGGGGCAGGTCAATAGCCTTCCTGGGAGCATCAACAAGGCAGGGGAGTATATTGAAGCCAGTTA

CATGAACCTGCAGAGACCATACACAGTGGCCATTGCTGGGTATGCCCTGGCCCTGATGAACAAACTGGAG

GAACCTTACCTCGGCAAGTTTCTGAACACAGCCAAAGATCGGAACCGCTGGGAGGAGCCTGACCAGCAGC

TCTACAACGTAGAGGCCACATCCTACGCCCTCCTGGCCCTGCTGCTGCTGAAAGACTTTGACTCTGTGCC

CCCTGTAGTGCGCTGGCTCAATGAGCAAAGATACTACGGAGGCGGCTATGGCTCCACCCAGGCTACCTTC

ATGGTATTCCAAGCCTTGGCCCAATATCAAACAGATGTCCCTGACCATAAGGACTTGAACATGGATGTGT

CCTTCCACCTCCCCAGCCGTAGCTCTGCAACCACGTTTCGCCTGCTCTGGGAAAATGGCAACCTCCTGCG

ATCGGAAGAGACCAAGCAAAATGAGGCCTTCTCTCTAACAGCCAAAGGAAAAGGCCGAGGCACATTGTCG

GTGGTGGCAGTGTATCATGCCAAACTCAAAAGCAAAGTCACCTGCAAGAAGTTTGACCTCAGGGTCAGCA

TAAGACCAGCCCCTGAGACAGCCAAGAAGCCCGAGGAAGCCAAGAATACCATGTTCCTTGAAATCTGCAC

CAAGTACTTGGGAGATGTGGACGCCACTATGTCCATCCTGGACATCTCCATGATGACTGGCTTTGCTCCA

GACACAAAGGACCTGGAACTGCTGGCCTCTGGAGTAGATAGATACATCTCCAAGTACGAGATGAACAAAG

CCTTCTCCAACAAGAACACCCTCATCATCTACCTAGAAAAGATTTCACACACCGAAGAAGACTGCCTGAC

CTTCAAAGTTCACCAGTACTTTAATGTGGACTTATCCAGCCCGGGTCGGTCAAGGTCTACTCCTATTAC

AACCTCGAGGAATCATGCACCCGGTTCTATCATCCAGAGAAGGACGATGGGATGCTCAGCAAGCTGTGCC

ACAGTGAAATGTGCCGGTGTGCTGAAGAGAACTGCTTCATGCAACAGTCACAGGAGAAGATCAACCTGAA

TGTCCGGCTAGACAAGGCTTGTGAGCCCGGAGTCGACTATGTGTACAAGACCGAGCTAACCAACATAGAG

CTGTTGGATGATTTTGATGAGTACACCATGACCATCCAGCAGGTCATCAAGTCAGGCTCAGATGAGGTGC

AGGCAGGGCAGCAACGCAAGTTCATCAGCCACATCAAGTGCAGAAACGCCCTGAAGCTGCAGAAAGGGAA

GAAGTACCTCATGTGGGCCTCTCCTCTGACCTCTGGGGAGAAAAGCCCAACACCAGCTACATCATTGGG

AAGGACACGTGGGTGGAGCACTGGCCTGAGGCAGAAGAATGCCAGGATCAGAAGTACCAGAAACAGTGCG

AAGAACTTGGGGCATTCACAGAATCTATGGTGGTTTATGGTTGTCCCAACTGACTACAGCCCAGCCCTCT

AATAAAGCTTCAGTTGTATTTCACCCATC
```

Reverse Complement of SEQ ID NO: 3

SEQ ID NO: 4

```
GATGGGTGAAATACAACTGAAGCTTTATTAGAGGGCTGGGCTGTAGTCAGTTGGGACAACCATAAACCACCATAG

ATTCTGTGAATGCCCCAAGTTCTTCGCACTGTTTCTGGTACTTCTGATCCTGGCATTCTTCTGCCTCAGGCCAGT

GCTCCACCCACGTGTCCTTCCCAATGATGTAGCTGGTGTTGGGCTTTTCTCCCCAGAGGTCAGAGGAGAGGCCCC

ACATGAGGTACTTCTTCCCTTTCTGCAGCTTCAGGGCGTTTCTGCACTTGATGTGGCTGATGAACTTGCGTTGCT

GCCCTGCCTGCACCTCATCTGAGCCTGACTTGATGACCTGCTGGATGGTCATGGTGTACTCATCAAAATCATCCA

ACAGCTCTATGTTGGTTAGCTCGGTCTTGTACACATAGTCGACTCCGGGCTCACAAGCCTTGTCTAGCCGGACAT

TCAGGTTGATCTTCTCCTGTGACTGTTGCATGAAGCAGTTCTCTTCAGCACACCGGCACATTTCACTGTGGCACA
```

-continued

```
GCTTGCTGAGCATCCCATCGTCCTTCTCTGGATGATAGAACCGGGTGCATGATTCCTCGAGGTTGTAATAGGAGT

AGACCTTGACCGACCCGGGCTGGATAAGTCCCACATTAAAGTACTGGTGAACTTTGAAGGTCAGGCAGTCTTCTT

CGGTGTGTGAAATCTTTTCTAGGTAGATGATGAGGGTGTTCTTGTTGGAGAAGGCTTTGTTCATCTCGTACTTGG

AGATGTATCTATCTACTCCAGAGGCCAGCAGTTCCAGGTCCTTTGTGTCTGGAGCAAAGCCAGTCATCATGGAGA

TGTCCAGGATGGACATAGTGGCGTCCACATCTCCCAAGTACTTGGTGCAGATTTCAAGGAACATGGTATTCTTGG

CTTCCTCGGGCTTCTTGGCTGTCTCAGGGGCTGGTCTTATGCTGACCCTGAGGTCAAACTTCTTGCAGGTGACTT

TGCTTTTGAGTTTGGCATGATACACTGCCACCACCGACAATGTGCCTCGGCCTTTTCCTTTGGCTGTTAGAGAGA

AGGCCTCATTTTGCTTGGTCTCTTCCGATCGCAGGAGGTTGCCATTTTCCCAGAGCAGGCGAAACGTGGTTGCAG

AGCTACGGCTGGGGAGGTGGAAGGACACATCCATGTTCAAGTCCTTATGGTCAGGGACATCTGTTTGATATTGGG

CCAAGGCTTGGAATACCATGAAGGTAGCCTGGGTGGAGCCATAGCCGCCTCCGTAGTATCTTTGCTCATTGAGCC

AGCGCACTACAGGGGGCACAGAGTCAAAGTCTTTCAGCAGCAGCAGGGCCAGGAGGGCGTAGGATGTGGCCTCTA

CGTTGTAGAGCTGCTGGTCAGGCTCCTCCCAGCGGTTCCGATCTTTGGCTGTGTTCAGAAACTTGCCGAGGTAAG

GTTCCTCCAGTTTGTTCATCAGGGCCAGGGCATACCCAGCAATGGCCACTGTGTATGGTCTCTGCAGGTTCATGT

AACTGGCTTCAATATACTCCCCTGCCTTGTTGATGCTCCCAGGAAGGCTATTGACCTGCCCCTCACAGATGTCCC

TGGCTTCCTGCAGTGCGATGAGGACGAAGGCTGTGAGTGACACATCTGCCTCCTTGGCGTTCCGGAAGCCACCAA

TCATTTCTTGGTGAATCACGGGCCCATCCTCCTGAAAGACACCATCCGGCTTCTGTTTCTCCAGAATCAACCATT

TAACAGCCCCACACAGGACGTGAGAGTCGATGGCGATGAGGTTGGCAGCTAGAGAGAAGACCTTGACCACGTAGG

CTGTCAGCCAGGTGCTGGGGGGCCGGTTGTTGAAGGCAGCATAGGCAGAGCTGGGCTGTTTGAAGGCCAGCTGCT

GGGTGTACCCTTTCTTGATGAGCTCCAGGGCCTCTTGCCTCTTCTCTATGCCGAACTTCTCCCACTGTTCGGTCT

GGTCCAGGTAGTGTACCGCAATGACTGTTGGTGTCATGCCAATCATGTTCTGTTCCCCACAGCCTGCGGGGGTCA

CGATCAGGTGTTTCAGCCGCTCCCCGTCCACAGCATCTTCAGCCATCTGAACCACCGGGCTCCCTTGCAGGATAA

TTCTGGTCTCAGAGTCTGTGTCTGGCACTTGGTCGCTAAGGTCTGCGGCAGGCACATCCACCTTCTGCACTCCCC

CTTGACCGAGCTTCTCTGGGTCCAGTGTATGGATGGCCACAGTTTTGTTGATTCTCATTCCTTCTGGCACGACCT

TCAGTGTCTTCTTGACACCATCACTGATGAAGTGATTGAAGACAGCAGCCTTGACCTCCACCTCTTGTTGGCCGA

TCTTCAAGGGGACAATGACATACGGTACAGCCACCGAGGACTTGGGAGGGATTTTGATGGTCTGGAAGTAGCGAT

TCTTGGCGGTGGCCATGCTGCAGAAGGCTGGATTATGCAACAGTTCCACCCTCACCTTAAGTTCCTCCTGTTCAC

GGTAGTTGAAGAGCACAGCTCTGATCTCCACCTGTTCGTTGCGCACTACAGAGTAGGGCAGCCGCAGGTCAATGA

AGAAGTCCTGCATCACTCTGATCTCATAGGGGTCTGCCACACAGATCCCTTTCTTGTCTGACAAGCTCACTGCCA

GAATCTCCCAGGTGGTGATGGAATCTTTGAGAAAGATGTTCATGACCTTCGTAGAGATTCCATTTTTCTCTGGTT

CTTTCAACTCTTCTATGGTCCACAACCAGCTCTGTGGGAAGTGGCTTCTAGAGATAATATCTTCTTCTGGAATTA

TGTCTTCCTCCAATTCACTCCTGGCCAGGCCCAGCACGTGGTCTCTTCTGTGTTGTTCACGCAGCTTGGTGATGT

GGTTGCAGCAGTCTATGAAGGCCTTTATGCAGTTCTCGCCCTGGGTGATGAGGCGTGCCCGGCGCTGGCAGCTGT

ATCTCATAGGGATATCCCGCATACCATCCTCACAACACTTCCGAAGACCCTTGTCAGTGTACTGACCAGCTTTGT

CCATCCTTCTTTCCATCAACTGTACTGAGCGACGGCGGCGGGCTGCTGGCTTGGTGCACTCAAGATCTGCTCTCT

GTTCAGTCTGCAGTCCTTGGCTTGTCTTGAAGGCCAGGCCTGCATCCATGAAGACACCAGCATAGTTCTTCCCAC

TGCCTGGGGTGCAGCCAATGTCTGCCTTCTCTACCACATCCCAGATCTTGCTCTGTGTGAGTTTGTTCTTCTTGT

TCAGCACAAACACTCCCTTGTCCACAGCCACTAGCCCCACTCGGGCCCCCTGGTTTCCTTCAATCCTGAGTGTCG

TTTGTTGCCCAGGTGCGAGATGGTTATCTCTTGGGTCACCCTTCACCACCAGCGTGCCAATACAGGAATCCTTCA

CATCCACCCACACAGAGTCAGCCACCACCTCCCTCTGGCCACTAGCTCCAATCAGGGTGTAGTAAGCCACCAGGC

GAAATGAAGGAATAAACTCTGGAGTGATGGGCAGGGACAAGACCACCAGGTCCTGGCCAGGCTCCCGAACCTGGC
```

-continued
```
GGCCTGCCTTCAGGAGCTTCCCCTTGTTCATAACCAGGTAGGTGTAGTATCGGATCTTGGCCTCATGGCCTGGGT

CTGTGCGCAGGTGGAAGTTGACATTGAGGTTGTCCCCCGGCTTGAGCTCCATTCGTGACACTGACAAGTGTAGGT

AGTTGTTGGAGTTGTGCATAGTGCTGTAGGGATGGGCCTCCATTGTCTTGGTGGCCTGCCGTGATTCTGGGAGAG

TGTCCTTCTTGGTGCGGACTGTGATGGTCAGGGGTTGGCGGCTGTTGGGTGTGTTGATGCTTAGCTTGGCCACGC

CATCATCTTGGGTGAGAGCCTTTGCATTAGATCCCTGAGTGACCACCAGCACTTTGCTGGCCGGAGAGCCATCGG

GGTTGGTCACGAACACCATGAGGTCAAAGGGCATGGCTGGCTTGAAGAATTTGGGTGTCTTGGTGAAGTGGATCT

GGTACGGGAAGTGACAATCGGGATCCCACTGCGCTCTGCCTCTACCATGTCACTACCTGAGTGCAGGATGACAG

TGACGGAGACATACAGGGACTTCCCCACCAGGGCGTCGGCGTTGGAAGGCCGTACCCCCTCCATCAGCACCTTCC

GGGTCAGCACTGCATCCCCCACACCATCCTCAATCACTACGCGCGTGAGGGAGTGGGCCAGAGAAATCTTCTTAT

CGCCATCCTGGACCCCAAAAATCACGAAGGCTGTCCCGTCCACGTTTTTCCCGTACAGGAACTTGGCTATGATGG

AAACTTCCAGGCCATTTGGGTCATCGATGTAATAAAATGTCTCTGTGGGCTCCACCCGGACCTCAAAACTGGGCA

GCACGTATTCCTTCACCTCAAACTCTGCGGAGAAGATCTGCTTCGGCGCATGTTCGTAAAAGGCTCGGATCTTCC

ACTGCCCCATGTTGACCAGTTCAGGAATGTTCCAAGACAAAGGCAAGATGCCGTGTTGGTTGTTGGAAGACAGAA

TGTCTCTCTTGACAGGAATGCCATCGGGGGTCTCAATGAGGATGACGACTGTCTTGCCCACGGGCAGTAGGTTGT

TGTCCACAGTGAAGATCCGATATAAGACAGTGGAGCCAGGGGTGTAGATGGTCTTGTCTGTCTGGATGAAGAGGT

ACCCACTCTGGAAGCTTACCATCACTGCTTTCTCCACCACCGTTTCCCCGAAGTTTGCCACCACTGTCACGTACT

TGTGCCCCTCCTTATCTGAGTTGAATTCCTTACTGGCTGGAATCTTGATGGAGACGCTTCTCAGATGTCCACTGG

CTCCTGTCAACACTGTCTTCTCACTGGTCAGCACTTGCCTCTTTAGGAAGTCTTGCACAGTGACTGTGACTGGGA

TGTCACCCTGAGCATCGTGGGCCTCCAGTACGATGGTCTCTTCGCTCTCCAGCCGTAGGACATTGGGAGTAATGA

TGGAATACATGGGGATCCCCAGAGCTAATGGGGAGCTGGCCAACAGCAGCAGTAGCACTAGTAGCTGGGACCCTG

AAGCTGGTCCCATAGTGAAGGAAAAAGGTGGAAGGAATGAAGGGGTAAGGGCAGGGGTGGGCAGAGGCGAGCTG

GGGCTGTAGCCGCTGGCTCTTTATATGGCTCTCCTCTCT

>gi|158138560|ref|NM_016994.2| Rattus norvegicus complement component 3
(C3), mRNA
                                                                 SEQ ID NO: 5
CTACCCCTTACCCCTCACTCCTTCCACCTTTGTCCTTTACCATGGGACCCACGTCAGGGTCCCAGCTACT

AGTGCTACTGCTGCTGTTGGCCAGCTCCCTGCTAGCTCTGGGGAGCCCCATGTACTCCATCATTACTCCC

AATGTCCTGCGGCTGGAGAGTGAAGAGACTTTCATACTAGAGGCCCATGATGCTCAGGGTGATGTCCCAG

TCACTGTCACTGTGCAAGACTTCCTAAAGAAGCAAGTGCTGACCAGTGAGAAGACAGTGTTGACAGGAGC

CACTGGACATCTGAACAGGGTCTCCATCAAGATTCCAGCCAGTAAGGAATTCAATGCAGATAAGGGGCAC

AAGTACGTGACAGTGGTGGCAAACTTCGGGGCAACAGTGGTGGAGAAAGCGGTGCTAGTAAGCTTTCAGA

GTGGTTACCTCTTCATCCAGACAGACAAGACCATCTACACCCCAGGCTCCACTGTTTTCTATCGGATCTT

CACTGTGGACAACAACCTATTGCCTGTGGGCAAGACAGTCGTCATCGTCATTGAGACCCCGGACGGCGTT

CCCATCAAGAGAGACATTCTATCTTCCCACAACCAATATGGCATCTTGCCTTTGTCTTGGAACATTCCAG

AACTGGTCAACATGGGCAGTGGAAGATCCGAGCCTTCTATGAACATGCACCAAAGCAGACCTTCTCTGC

AGAGTTTGAGGTGAAGGAATACGTGCTGCCCAGTTTCGAAGTCCTGGTGGAGCCTACAGAGAAATTTTAT

TACATCGATGACCCAAAGGGCCTGGAAGTTTCCATCACAGCCAGATTCCTGTATGGGAAGAACGTGGACG

GGACAGCTTCGTGATCTTTGGGGTCCAGGATGAGGATAAGAAGATTTCTCTGGCCCAGTCCCTCACCCG

CGTGCTGATCGAGGATGGTTCAGGGGAGGCAGTGCTCAGCCGAAAAGTGCTGATGGACGGGGTACGGCCC

TCCAGCCCAGAAGCCCTAGTGGGGAAGTCCCTGTACGTCTCTGTCACTGTTATCCTGCACTCAGGTAGCG

ACATGGTAGAGGCAGAGCGCAGTGGGATCCCAATTGTCACTTCCCCGTACCAGATCCACTTCACCAAGAC
```

-continued

```
ACCCAAATTCTTCAAGCCAGCCATGCCTTTCGACCTCATGGTGTTTGTGACCAACCCTGATGGCTCTCCA

GCCCGCAGAGTGCCAGTAGTCACTCAGGGATCCGACGCGCAGGCTCTCACCCAGGATGATGGTGTGGCCA

AGCTGAGCGTCAACACACCCAACAACCGCCAACCCCTGACTATCACGGTCCGCACCAAGAAGGAGGGTAT

CCCGGACGCGCGGCAGGCCACCAGGACGATGCAGGCCCAGCCCTACAGCACTATGCACAATTCCAACAAC

TACCTGCACTTGTCAGTGTCTCGGGTGGAGCTCAAGCCTGGGGACAACCTCAATGTCAACTTCCACCTGC

GCACGGACGCTGGCCAAGAGGCCAAGATCCGATACTACACCTATCTGGTTATGAACAAGGGGAAGTTACT

GAAGGCAGGCCGTCAGGTTCGGGAGCCTGGCCAGGACCTGGTGGTCTTGTCACTGCCCATCACTCCAGAA

TTTATACCTTCCTTCCGCCTGGTGGCTTACTACACCCTGATTGGAGCTAATGGCCAAAGGGAGGTGGTGG

CCGACTCAGTGTGGGTGGATGTGAAGGACTCCTGTGTAGGCACGCTGGTGGTGAAAGGTGACCCAAGAGA

TAACCGACAGCCCGCGCCTGGGCATCAAACGACACTAAGGATCGAGGGGAACCAGGGGGCCCGAGTGGGG

CTAGTGGCTGTGGACAAGGGGGTGTTTGTGCTGAACAAGAAGAACAAACTCACACAGAGCAAGATCTGGG

ATGTAGTAGAGAAGGCAGACATTGGCTGCACCCCAGGCAGTGGGAAGAACTATGCGGGTGTCTTCATGGA

TGCTGGCCTGACCTTCAAGACAAACCAAGGCCTGCAGACTGATCAGAGAGAAGATCCTGAGTGCGCCAAG

CCAGCTGCCCGCCGCCGTCGCTCAGTGCAGTTGATGGAAAGGAGGATGGACAAAGCTGGTCAGTACACCG

ACAAGGGTCTGCGGAAGTGTTGTGAGGATGGCATGCGTGATATCCCTATGAAGTACAGCTGCCAGCGCCG

GGCTCGCCTCATCACCCAGGGCGAGAGCTGCCTGAAGGCCTTCATGGACTGCTGCAACTATATCACCAAG

CTTCGTGAGCAGCACAGAAGAGACCATGTGCTGGGCCTGGCCAGGAGTGATGTGGATGAAGACATAATCC

CAGAAGAAGATATTATCTCTAGAAGCCACTTCCCAGAGAGCTGGTTGTGGACCATAGAAGAGTTGAAAGA

ACCAGAGAAAAATGGAATCTCTACGAAGGTCATGAACATCTTTCTCAAAGATTCCATCACCACCTGGGAG

ATTCTGGCAGTGAGCTTGTCCGACAAGAAAGGGATCTGTGTGGCAGACCCCTATGAGATCACAGTGATGC

AGGACTTCTTCATTGACCTGCGACTGCCCTACTCTGTGGTGCGCAATGAACAGGTGGAGATCAGAGCTGT

GCTCTTCAATTACCGTGAACAGGAGAAACTTAAGGTAAGGGTGGAACTGTTGCATAACCCAGCCTTCTGC

AGCATGGCCACTGCCAAGAAGCGGTACTACCAGACCATCGAAATCCCTCCCAAGTCCTCTGTGGCTGTGC

CTTATGTCATTGTCCCCTTGAAGATCGGCCTCCAGGAGGTGGAGGTCAAGGCCGCCGTCTTCAACCACTT

CATCAGTGATGGTGTCAAGAAGATACTGAAGGTCGTGCCAGAAGGAATGAGAGTCAACAAAACTGTGGCT

GTCCGTACACTGGATCCAGAACACCTCGGTCAAGGGGGAGTGCAGAGGGAGGATGTACCTGCAGCAGACC

TCAGTGACCAAGTGCCAGACACAGATTCTGAGACCAGAATTCTCCTGCAAGGGACCCCGGTGGCTCAGAT

GGCCGAGGACGCTGTGGACGGGGAGCGGCTGAAACACCTGATCGTGACCCCCTCTGGCTGTGGGGAGCAG

AACATGATTGGCATGACACCCACGGTCATTGCAGTACACTATCTGGATCAGACCGAACAGTGGGAGAAAT

TCGGCCTAGAGAAGAGGCAAGAAGCTCTGGAGCTCATCAAGAAAGGGTACACCCAGCAGCTGGCTTTCAA

ACAGCCCAGCTCTGCCTATGCTGCCTTCAACAACCGGCCTCCCAGCACCTGGCTGACAGCCTATGTGGTC

AAGGTCTTCTCTCTGGCTGCCAACCTCATCGCCATCGACTCTCAGGTCCTGTGTGGGCTGTCAAATGGC

TGATTCTGGAGAAACAGAAGCCAGATGGTGTCTTTCAGGAGGACGGACCAGTGATTCACCAAGAAATGAT

TGGTGGCTTCCGGAACACCAAGGAGGCAGATGTGTCGCTTACAGCCTTTGTCCTCATCGCACTGCAGGAA

GCCAGAGATATCTGTGAGGGGCAGGTCAACAGCCTTCCCGGGAGCATCAACAAGGCAGGGGAGTATCTTG

AAGCCAGTTACCTGAACCTGCAGAGACCATACACAGTAGCCATTGCTGGGTATGCCCTGGCCCTGATGAA

CAAACTGGAGGAACCTTACCTCACCAAGTTTCTGAACACAGCCAAAGATCGGAACCGCTGGGAGGAGCCT

GGCCAGCAGCTCTACAATGTGGAGGCCACCTCCTACGCCCTCCTGGCCCTGCTGCTGCTGAAAGACTTTG

ACTCTGTGCCTCCTGTGGTGCGCTGGCTCAACGAGCAAAGATACTACGGAGGTGGCTATGGCTCCACGCA

GGCTACCTTCATGGTATTCCAAGCCTTGGCTCAATACCAAACAGATGTCCCTGACCACAAGGACTTGAAC
```

-continued

```
ATGGATGTGTCCCTCCACCTCCCCAGCCGCAGCTCCCCAACTGTGTTTCGCCTGCTATGGGAAAGTGGCA

GTCTCCTGAGATCAGAAGAGACCAAGCAGAATGAGGGCTTTTCTCTGACAGCCAAAGGAAAAGGCCAAGG

CACACTGTCGGTGGTGACAGTGTATCACGCCAAAGTCAAAGGCAAAGCCACCTGCAAGAAGTTTGACCTC

AGGGTCACCATAAAACCAGCCCCTGAGACAGCCAAGAAGCCCCAGGATGCCAAGAGTTCTATGATCCTTG

ACATCTGCACCAGGTACTTGGGAGACGTGGATGCTACTATGTCCATCCTGGACATCTCCATGATGACTGG

CTTTATTCCAGACACAAACGACCTGGAACTGCTGAGCTCTGGAGTAGACAGATACATTTCCAAGTATGAG

ATGGACAAAGCCTTCTCCAACAAGAACACCCTCATCATCTACCTAGAAAAGATCTCACACTCCGAAGAAG

ACTGCCTGTCCTTCAAAGTCCACCAGTTCTTTAACGTGGGACTTATCCAGCCGGGGTCGGTCAAGGTCTA

CTCCTACTACAATCTAGAGGAGTCATGCACCCGGTTCTATCATCCGGAGAAGGACGATGGAATGCTGAGC

AAGCTGTGCCACAATGAAATGTGCCGCTGTGCAGAGGAGAACTGCTTCATGCATCAGTCACAGGATCAGG

TCAGCCTGAATGAACGACTAGACAAGGCTTGTGAGCCTGGAGTGGACTACGTGTACAAGACCAAGCTAAC

GACGATAGAGCTGTCGGATGATTTTGATGAGTACATCATGACCATCGAGCAGGTCATCAAGTCAGGCTCA

GATGAGGTGCAGGCAGGTCAGGAACGAAGGTTCATCAGCCACGTCAAGTGCAGAAACGCCCTAAAGCTGC

AGAAAGGGAAGCAGTACCTCATGTGGGGCCTCTCCTCCGACCTCTGGGGAGAAAAGCCCAATACCAGCTA

CATCATTGGGAAGGACACGTGGGTGGAGCACTGGCCCGAGGCAGAGGAATGTCAGGATCAGAAGAACCAG

AAACAGTGCGAAGACCTCGGGGCATTCACAGAAACAATGGTGGTTTTCGGCTGCCCCAACTGACCACAAC

CTCCAATAAAGCTTCAGTTGTATTTTACCCATCAAAAAAAAAAAAAAAAAA

Reverse Complement of SEQ ID NO : 5
                                                                   SEQ ID NO: 6
TTTTTTTTTTTTTTTTTGATGGGTAAAATACAACTGAAGCTTTATTGGAGGTTGTGGTCAGTTGGGGCAGCCGA

AAACCACCATTGTTTCTGTGAATGCCCCGAGGTCTTCGCACTGTTTCTGGTTCTTCTGATCCTGACATTCCTCTG

CCTCGGGCCAGTGCTCCACCCACGTGTCCTTCCCAATGATGTAGCTGGTATTGGGCTTTTCTCCCCAGAGGTCGG

AGGAGAGGCCCCACATGAGGTACTGCTTCCCTTTCTGCAGCTTTAGGGCGTTTCTGCACTTGACGTGGCTGATGA

ACCTTCGTTCCTGACCTGCCTGCACCTCATCTGAGCCTGACTTGATGACCTGCTCGATGGTCATGATGTACTCAT

CAAAATCATCCGACAGCTCTATCGTCGTTAGCTTGGTCTTGTACACGTAGTCCACTCCAGGCTCACAAGCCTTGT

CTAGTCGTTCATTCAGGCTGACCTGATCCTGTGACTGATGCATGAAGCAGTTCTCCTCTGCACAGCGGCACATTT

CATTGTGGCACAGCTTGCTCAGCATTCCATCGTCCTTCTCCGGATGATAGAACGGGTGCATGACTCCTCTAGAT

TGTAGTAGGAGTAGACCTTGACCGACCCCGGCTGGATAAGTCCCACGTTAAAGAACTGGTGGACTTTGAAGGACA

GGCAGTCTTCTTCGGAGTGTGAGATCTTTTCTAGGTAGATGATGAGGGTGTTCTTGTTGGAGAAGGCTTTGTCCA

TCTCATACTTGGAAATGTATCTGTCTACTCCAGAGCTCAGCAGTTCCAGGTCGTTTGTGTCTGGAATAAAGCCAG

TCATCATGGAGATGTCCAGGATGGACATAGTAGCATCCACGTCTCCCAAGTACCTGGTGCAGATGTCAAGGATCA

TAGAACTCTTGGCATCCTGGGGCTTCTTGGCTGTCTCAGGGGCTGGTTTTATGGTGACCCTGAGGTCAAACTTCT

TGCAGGTGGCTTTGCCTTTGACTTTGGCGTGATACACTGTCACCACCGACAGTGTGCCTTGGCCTTTTCCTTTGG

CTGTCAGAGAAAGCCCTCATTCTGCTTGGTCTCTTCTGATCTCAGGAGACTGCCACTTTCCCATAGCAGGCGAA

ACACAGTTGGGGAGCTGCGGCTGGGGAGGTGGAGGGACACATCCATGTTCAAGTCCTTGTGGTCAGGGACATCTG

TTTGGTATTGAGCCAAGGCTTGGAATACCATGAAGGTAGCCTGCGTGGAGCCATAGCCACCTCCGTAGTATCTTT

GCTCGTTGAGCCAGCGCACCACAGGAGGCACAGAGTCAAAGTCTTTCAGCAGCAGCAGGGCCAGGAGGGCGTAGG

AGGTGGCCTCCACATTGTAGAGCTGCTGGCCAGGCTCCTCCCAGCGGTTCCGATCTTTGGCTGTGTTCAGAAACT

TGGTGAGGTAAGGTTCCTCCAGTTTGTTCATCAGGGCCAGGGCATACCCAGCAATGGCTACTGTGTATGGTCTCT

GCAGGTTCAGGTAACTGGCTTCAAGATACTCCCCTGCCTTGTTGATGCTCCCGGGAAGGCTGTTGACCTGCCCCT
```

-continued

```
CACAGATATCTCTGGCTTCCTGCAGTGCGATGAGGACAAAGGCTGTAAGCGACACATCTGCCTCCTTGGTGTTCC

GGAAGCCACCAATCATTTCTTGGTGAATCACTGGTCCGTCCTCCTGAAAGACACCATCTGGCTTCTGTTTCTCCA

GAATCAGCCATTTGACAGCCCCACACAGGACCTGAGAGTCGATGGCGATGAGGTTGGCAGCCAGAGAGAAGACCT

TGACCACATAGGCTGTCAGCCAGGTGCTGGGAGGCCGGTTGTTGAAGGCAGCATAGGCAGAGCTGGGCTGTTTGA

AAGCCAGCTGCTGGGTGTACCCTTTCTTGATGAGCTCCAGAGCTTCTTGCCTCTTCTCTAGGCCGAATTTCTCCC

ACTGTTCGGTCTGATCCAGATAGTGTACTGCAATGACCGTGGGTGTCATGCCAATCATGTTCTGCTCCCCACAGC

CAGAGGGGGTCACGATCAGGTGTTTCAGCCGCTCCCCGTCCACAGCGTCCTCGGCCATCTGAGCCACCGGGGTCC

CTTGCAGGAGAATTCTGGTCTCAGAATCTGTGTCTGGCACTTGGTCACTGAGGTCTGCTGCAGGTACATCCTCCC

TCTGCACTCCCCCTTGACCGAGGTGTTCTGGATCCAGTGTACGGACAGCCACAGTTTTGTTGACTCTCATTCCTT

CTGGCACGACCTTCAGTATCTTCTTGACACCATCACTGATGAAGTGGTTGAAGACGGCGGCCTTGACCTCCACCT

CCTGGAGGCCGATCTTCAAGGGGACAATGACATAAGGCACAGCCACAGAGGACTTGGGAGGGATTTCGATGGTCT

GGTAGTACCGCTTCTTGGCAGTGGCCATGCTGCAGAAGGCTGGGTTATGCAACAGTTCCACCCTTACCTTAAGTT

TCTCCTGTTCACGGTAATTGAAGAGCACAGCTCTGATCTCCACCTGTTCATTGCGCACCACAGAGTAGGGCAGTC

GCAGGTCAATGAAGAAGTCCTGCATCACTGTGATCTCATAGGGGTCTGCCACACAGATCCCTTTCTTGTCGGACA

AGCTCACTGCCAGAATCTCCCAGGTGGTGATGGAATCTTTGAGAAAGATGTTCATGACCTTCGTAGAGATTCCAT

TTTTCTCTGGTTCTTTCAACTCTTCTATGGTCCACAACCAGCTCTCTGGGAAGTGGCTTCTAGAGATAATATCTT

CTTCTGGGATTATGTCTTCATCCACATCACTCCTGGCCAGGCCCAGCACATGGTCTCTTCTGTGCTGCTCACGAA

GCTTGGTGATATAGTTGCAGCAGTCCATGAAGGCCTTCAGGCAGCTCTCGCCCTGGGTGATGAGGCGAGCCCGGC

GCTGGCAGCTGTACTTCATAGGGATATCACGCATGCCATCCTCACAACACTTCCGCAGACCCTTGTCGGTGTACT

GACCAGCTTTGTCCATCCTCCTTTCCATCAACTGCACTGAGCGACGGCGGCGGGCAGCTGGCTTGGCGCACTCAG

GATCTTCTCTGATCAGTCTGCAGGCCTTGGTTTGTCTTGAAGGTCAGGCCAGCATCCATGAAGACACCCGCAT

AGTTCTTCCCACTGCCTGGGGTGCAGCCAATGTCTGCCTTCTCTACTACATCCCAGATCTTGCTCTGTGTGAGTT

TGTTCTTCTTGTTCAGCACAAACACCCCCTTGTCCACAGCCACTAGCCCCACTCGGGCCCCCTGGTTCCCCTCGA

TCCTTAGTGTCGTTTGATGCCCAGGCGCGGGCTGTCGGTTATCTCTTGGGTCACCTTTCACCACCAGCGTGCCTA

CACAGGAGTCCTTCACATCCACCCACACTGAGTCGGCCACCACCTCCCTTTGGCCATTAGCTCCAATCAGGGTGT

AGTAAGCCACCAGGCGGAAGGAAGGTATAAATTCTGGAGTGATGGGCAGTGACAAGACCACCAGGTCCTGGCCAG

GCTCCCGAACCTGACGGCCTGCCTTCAGTAACTTCCCCTTGTTCATAACCAGATAGGTGTAGTATCGGATCTTGG

CCTCTTGGCCAGCGTCCGTGCGCAGGTGGAAGTTGACATTGAGGTTGTCCCCAGGCTTGAGCTCCACCCGAGACA

CTGACAAGTGCAGGTAGTTGTTGGAATTGTGCATAGTGCTGTAGGGCTGGGCCTGCATCGTCCTGGTGGCCTGCC

GCGCGTCCGGGATACCCTCCTTCTTGGTGCGGACCGTGATAGTCAGGGGTTGGCGGTTGTTGGGTGTGTTGACGC

TCAGCTTGGCCACACCATCATCCTGGGTGAGAGCCTGCGCGTCGGATCCCTGAGTGACTACTGGCACTCTGCGGG

CTGGAGAGCCATCAGGGTTGGTCACAAACACCATGAGGTCGAAAGGCATGGCTGGCTTGAAGAATTTGGGTGTCT

TGGTGAAGTGGATCTGGTACGGGGAAGTGACAATTGGGATCCCACTGCGCTCTGCCTCTACCATGTCGCTACCTG

AGTGCAGGATAACAGTGACAGAGACGTACAGGGACTTCCCCACTAGGGCTTCTGGGCTGGAGGGCCGTACCCCGT

CCATCAGCACTTTTCGGCTGAGCACTGCCTCCCCTGAACCATCCTCGATCAGCACGCGGGTGAGGGACTGGGCCA

GAGAAATCTTCTTATCCTCATCCTGGACCCCAAAGATCACGAAAGCTGTCCCGTCCACGTTCTTCCCATACAGGA

ATCTGGCTGTGATGGAAACTTCCAGGCCCTTTGGGTCATCGATGTAATAAAATTTCTCTGTAGGCTCCACCAGGA

CTTCGAAACTGGGCAGCACGTATTCCTTCACCTCAAACTCTGCAGAGAAGGTCTGCTTTGGTGCATGTTCATAGA

AGGCTCGGATCTTCCACTGCCCCATGTTGACCAGTTCTGGAATGTTCCAAGACAAAGGCAAGATGCCATATTGGT

TGTGGGAAGATAGAATGTCTCTCTTGATGGGAACGCCGTCCGGGGTCTCAATGACGATGACGACTGTCTTGCCCA

CAGGCAATAGGTTGTTGTCCACAGTGAAGATCCGATAGAAAACAGTGGAGCCTGGGGTGTAGATGGTCTTGTCTG
```

-continued

```
TCTGGATGAAGAGGTAACCACTCTGAAAGCTTACTAGCACCGCTTTCTCCACCACTGTTGCCCCGAAGTTTGCCA

CCACTGTCACGTACTTGTGCCCCTTATCTGCATTGAATTCCTTACTGGCTGGAATCTTGATGGAGACCCTGTTCA

GATGTCCAGTGGCTCCTGTCAACACTGTCTTCTCACTGGTCAGCACTTGCTTCTTTAGGAAGTCTTGCACAGTGA

CAGTGACTGGGACATCACCCTGAGCATCATGGGCCTCTAGTATGAAAGTCTCTTCACTCTCCAGCCGCAGGACAT

TGGGAGTAATGATGGAGTACATGGGGCTCCCCAGAGCTAGCAGGGAGCTGGCCAACAGCAGCAGTAGCACTAGTA

GCTGGGACCCTGACGTGGGTCCCATGGTAAAGGACAAAGGTGGAAGGAGTGAGGGGTAAGGGGTAG
```

```
>gi|982312947|ref|XM_005587719.2| PREDICTED: Macaca fascicularis
complement component 3 (C3), mRNA
                                                              SEQ ID NO: 7
AAAGCCAACTCCAGCAGTCACTGCTCACTCCTCCCCATCCTCTCCCTCTGTCCCTCTGTCCCTCTGACCC

TGCACTGTCCCAGCACCATGGGACTCACCTCAGGTCCCAGCCTGCTGCTCCTGCTACTAATCCACCTCCC

CCTGGCTCTGGGGACTCCCATGTACTCTATGATCACCCCAAACGTCTTGCGGCTGGAGAGTGAGGAGACC

GTGGTGCTGGAGGCCCATGACGCGAATGGGGATGTTCCGGTCACTGTCACTGTCCACGACTTCCCAGGCA

AAAAACTGGTGCTGTCCAGTGAGAAGACCGTGCTGACCCCTGCCACCAGCCACATGGGCAGCGTCACCAT

CAGGATCCCAGCCAACAAGGAGTTCAAGTCAGAAAAGGGGCACAACAAGTTCGTGACTGTGCAGGCCACC

TTCGGGGCCCAAGTGGTGGAGAAGGTGGTACTGGTCAGCCTTCAGAGCGGGTACCTCTTCATCCAGACAG

ACAAGACCATCTACACCCCTGGCTCCACAGTTCTCTGTCGGATCTTCACCGTCAACCACAAGCTGCTACC

CGTGGGCCGGACGGTCGTGGTCAACATTGAGAACCCGGACGGCATCCCGGTCAAGCAGGACTCCTTGTCT

TCTCAGAACCAATTTGGCATCTTGCCCTTGTCTTGGGACATTCCGGAACTCGTCAACATGGGCCAGTGGA

AGATCCGAGCCTACTATGAAAATTCGCCGCAACAGGTCTTCTCCACTGAGTTTGAGGTGAAGGAGTACGT

GCTGCCCAGTTTCGAGGTCATAGTGGAGCCTACAGAGAAATTCTACTACATCTATAACCAGAAGGGCCTG

GAGGTCACCATCACCGCCAGGTTCCTCTATGGAAAGAAAGTGGAGGGAACTGCCTTTGTCATCTTCGGGA

TCCAGGATGGCGAGCAGAGGATTTCCCTGCCTGAATCCCTCAAGCGCATCCAGATTGAGGATGGCTCAGG

AGACGCCGTGCTGAGCCGGAAGGTACTGCTGGACGGGGTGCAGAATCCCCGACCGGAAGACCTAGTGGGG

AAGTCCTTGTATGTGTCTGTCACCGTTATCCTGCACTCAGGCAGTGACATGGTGCAGGCGGAGCGCAGCG

GGATCCCCATCGTGACCTCTCCCTACCAGATCCACTTCACCAAGACGCCCAAGTACTTCAAACCAGGAAT

GCCCTTTGACCTCATGGTGTTCGTGACGAACCCCGATGGCTCTCCAGCCTACCGAGTCCCCGTGGCAGTC

CAGGGCGAGGACGCTGTGCAGTCTCTAACCCAGGGAGACGGCGTGGCCAAACTCAGCATCAACACACACC

CCAGCCAGAAGCCCTTGAGCATCACGGTGCGCACGAAGAAGCGGGAGCTCTCGGAGGCGGAGCAGGCTAC

CAGGACCATGGAGGCTCAGCCCTACAGCACCGTGGGCAACTCCAACAATTACCTGCATCTCTCAGTGCCA

CGTGCAGAGCTCAGACCTGGGGAGACCCTCAACGTCAACTTCCTCCTGCGAATGGACCGCACCCAGGAGG

CCAAGATCCGCTACTACACCTACCTGATTATGAACAAAGGCAAGCTGTTGAAGGTGGGACGCCAGGTGCG

AGAGCCTGGCCAGGACCTGGTGGTGCTGCCCCTGTCCATCACCACCGACTTCATCCCTTCCTTCCGCCTG

GTGGCCTACTACACGCTGATCGGCGCCAACGGCCAGAGGGAAGTGGTGGCCGACTCCGTGTGGGTGGACG

TCAAGGACTCTTGCGTGGGCTCGCTGGTGGTAAAAAGCGGCCAGTCAGAAGACAGGCAGCCTTTACCCGG

GCAGCAGATGACCCTGAAGATAGAGGGTGACCACGGGGCCCGGTGGGACTGGTGGCTGTGGACAAGGGC

GTGTTTGTGCTGAATAAGAAGAACAAGCTGACGCAGAGTAAGATCTGGGACGTGGTGGAGAAGGCAGACA

TCGGCTGCACCCCAGGCAGTGGGAAGGATTACGCTGGTGTCTTCTCGGATGCAGGCCTGACCTTTGCGAG

CAGCAGTGGCCAGCAGACGGCCCAGAGGGCAGAACTTCAGTGCCCACAGCCAGCCGCCCGCCGACGCCGT

TCCGTGCAGCTCGCGGAGAAGAGAATGGACAAAGTTGGTCAGTACCCCAAGGAGCTGCGCAAGTGCTGCG
```

-continued

```
AGCACGGTATGCGGGAGAACCCCATGAGGTTCTCATGCCAGCGCCGGACCCGTTACATCACCCTGGACGA
GGCGTGCAAGAAGGCCTTCCTGGACTGCTGCAACTACATCACCGAGCTGCGGCGGCAGCACGCGCGGGCC
AGTCACCTGGGCCTGGCCAGGAGTAACCTGGATGAGGACATCATCGCAGAAGAGAACATCGTTTCCCGAA
GTGAGTTCCCAGAGAGTTGGCTGTGGAAGATTGAAGAGTTGAAAGAGGCACCGAAAAACGGAATCTCCAC
GAAGCTCATGAATATATTTTTGAAAGACTCCATCACCACGTGGGAGATTCTGGCCGTGAGCTTGTCAGAC
AAGAAAGGGATCTGTGTGGCAGACCCCTTCGAGGTCACAGTAATGCAGGACTTCTTCATCGACCTGCGGC
TACCCTACTCTGTTGTTCGAAACGAGCAGGTGGAAATCCGAGCTGTTCTCTACAATTACCGGCAGAACCA
AGAGCTCAAGGTGAGGGTGGAACTACTCCACAATCCAGCCTTCTGCAGCCTGGCCACCGCCAAGAGGCGT
CACCAGCAGACCGTAACCATCCCCCCCAAGTCCTCGCTGTCCGTTCCTTATGTCATCGTGCCCCTAAAGA
CCGGCCAGCAGGAAGTGGAAGTCAAGGCTGCCGTCTACCATTTTTTCATCAGTGACGGTGTCAGGAAGTC
CCTGAAGGTCGTGCCGGAAGGAATCAGAATGAACAAAACTGTGGCTGTTCGCACGCTGGATCCAGAACGC
CTGGGCCAGGAAGGAGTGCAGAGAGAGGACGTCCCACCTGCAGACCTCAGTGACCAAGTCCCGGACACCG
AGTCTGAGACCAGAATTCTCCTGCAAGGGACCCCGGTGGCCCAGATGACAGAGGATGCCATCGATGCGGA
ACGGCTGAAGCACCTCATCGTGACCCCCTCGGGCTGCGGAGAACAGAACATGATCACCATGACGCCCACA
GTCATCGCTGTGCATTACCTGGATGAAACGGAACAGTGGGAGAAGTTCGGCCCGGAGAAGCGGCAGGGGG
CCTTGGAGCTCATCAAGAAGGGGTACACCCAGCAGCTGGCCTTCAGACAACCCAGCTCTGCCTTTGCGGC
CTTCCTGAACCGGGCACCCAGCACCTGGCTGACCGCCTACGTGGTCAAGGTCTTCTCTCTGGCTGTCAAC
CTCATTGCCATCGACTCCCAGGTCCTCTGCGGGGCTGTTAAATGGCTGATCCTGGAGAAGCAGAAGCCCG
ACGGGGTCTTCCAGGAGGATGCGCCCGTGATACATCAAGAAATGACTGGTGGATTCCGGAACACCAACGA
GAAAGACATGGCCCTCACGGCCTTTGTTCTCATCTCGCTGCAAGAGGCTAAAGAGATTTGCGAGGAGCAG
GTCAACAGCCTGCCCGGCAGCATCACTAAAGCAGGAGACTTCCTTGAAGCCAACTACATGAACCTACAGA
GATCCTACACTGTGGCCATCGCTGCCTATGCCCTGGCCCAGATGGGCAGGCTGAAGGGACCTCTTCTCAA
CAAATTTCTGACCACAGCCAAAGATAAGAACCGCTGGGAGGAGCCTGGTCAGCAGCTCTACAATGTGGAG
GCCACATCCTATGCCCTCTTGGCCCTACTGCAGCTAAAAGACTTTGACTTTGTGCCTCCCGTCGTGCGTT
GGCTCAATGAACAGAGATACTACGGTGGTGGCTATGGCTCTACCCAGGCCACCTTCATGGTGTTCCAAGC
CTTGGCTCAATACCAAAAGGATGTCCCTGATCACAAGGAACTGAACCTGGATGTGTCCCTCCAACTGCCC
AGTCGCAGCTCCAAGATCATCCACCGTATCCACTGGGAATCTGCCAGCCTCCTGCGATCAGAAGAGACCA
AGGAAAATGAGGGTTTCACAGTCACAGCTGAAGGAAAAGGCCAAGGCACCTTGTCGGTAGTGACAATGTA
CCATGCTAAGGCCAAAGGTCAACTCACCTGTAATAAATTCGACCTCAAGGTCACCATAAAACCAGCACCG
GAAACAGAAAGAGGCCTCAGGATGCCAAGAACACTATGATCCTTGAGATCTGTACCAGGTACCGGGGAG
ACCAGGATGCCACTATGTCTATACTGGACATATCCATGATGACTGGCTTCGTTCCAGACACAGATGACCT
CAAGCAGCTGGCAAACGGCGTTGACAGATACATCTCCAAGTATGAGCTGGACAAAGCCTTCTCCGATAGG
AACACCCTCATCATCTACCTGGACAAGGTCTCACACTCTGAGGATGACTGTATAGCTTTCAAAGTTCACC
AATATTTTAATGTAGAGCTTATCCAGCCTGGTGCAGTCAAGGTCTACGCCTATTACAACCTGGCGGAAAG
CTGTACCCGGTTCTACCACCCAGAAAAGGAGGATGGAAAGCTGAACAAGCTCTGTCGTGATGAGCTGTGC
CGCTGTGCTGAGGAGAATTGCTTCATACAAAAGTTGGATGACAAAGTCACCCTGGAAGAACGGCTGGACA
AGGCCTGTGAGCCAGGAGTGGACTATGTGTACAAGACCCGACTGGTCAAGGCCCAGCTGTCCAATGACTT
TGACGAGTACATCATGGCCATTGAGCAGATCATCAAGTCAGGCTCGGATGAGGTGCAGGTTGGACAACAG
CGCACGTTCATCAGCCCCATCAAGTGCAGGGAAGCCCTGAAGCTGGAGGAGAGGGAAACACTACCTCATGT
GGGGTCTCTCCTCCGATTTCTGGGGAGAGAAACCCAATCTCAGCTACATCATCGGGAAGGACACCTGGGT
GGAGCACTGGCCCGAGGAGGACGAATGCCAAGATGAAGAGAACCAGAAACAATGCCAGGACCTCGGCACC
```

-continued

```
TTCACTGAGAACATGGTTGTCTTTGGGTGCCCCAACTGACCACACCCCCATTCCCCACTCCCAATAAAG

CTTCAGTTATATTTCA
```

Reverse Complement of SEQ ID NO: 7

SEQ ID NO: 8
```
TGAAATATAACTGAAGCTTTATTGGGAGTGGGGGAATGGGGGTGTGGTCAGTTGGGGCACCCAAAGACAACCATG

TTCTCAGTGAAGGTGCCGAGGTCCTGGCATTGTTTCTGGTTCTCTTCATCTTGGCATTCGTCCTCCTCGGGCCAG

TGCTCCACCCAGGTGTCCTTCCCGATGATGTAGCTGAGATTGGGTTTCTCTCCCCAGAAATCGGAGGAGAGACCC

CACATGAGGTAGTGTTTCCTCTCCTCCAGCTTCAGGGCTTCCCTGCACTTGATGGGGCTGATGAACGTGCGCTGT

TGTCCAACCTGCACCTCATCCGAGCCTGACTTGATGATCTGCTCAATGGCCATGATGTACTCGTCAAAGTCATTG

GACAGCTGGGCCTTGACCAGTCGGGTCTTGTACACATAGTCCACTCCTGGCTCACAGGCCTTGTCCAGCCGTTCT

TCCAGGGTGACTTTGTCATCCAACTTTTGTATGAAGCAATTCTCCTCAGCACAGCGGCACAGCTCATCACGACAG

AGCTTGTTCAGCTTTCCATCCTCCTTTTCTGGGTGGTAGAACCGGGTACAGCTTTCCGCCAGGTTGTAATAGGCG

TAGACCTTGACTGCACCAGGCTGGATAAGCTCTACATTAAAATATTGGTGAACTTTGAAAGCTATACAGTCATCC

TCAGAGTGTGAGACCTTGTCCAGGTAGATGATGAGGGTGTTCCTATCGGAGAAGGCTTTGTCCAGCTCATACTTG

GAGATGTATCTGTCAACGCCGTTTGCCAGCTGCTTGAGGTCATCTGTGTCTGGAACGAAGCCAGTCATCATGGAT

ATGTCCAGTATAGACATAGTGGCATCCTGGTCTCCCCGGTACCTGGTACAGATCTCAAGGATCATAGTGTTCTTG

GCATCCTGAGGCCTCTTTTCTGTTTCCGGTGCTGGTTTTATGGTGACCTTGAGGTCGAATTTATTACAGGTGAGT

TGACCTTTGGCCTTAGCATGGTACATTGTCACTACCGACAAGGTGCCTTGGCCTTTTCCTTCAGCTGTGACTGTG

AAACCCTCATTTTCCTTGGTCTCTTCTGATCGCAGGAGGCTGGCAGATTCCCAGTGGATACGGTGGATGATCTTG

GAGCTGCGACTGGGCAGTTGGAGGGACACATCCAGGTTCAGTTCCTTGTGATCAGGGACATCCTTTTGGTATTGA

GCCAAGGCTTGGAACACCATGAAGGTGGCCTGGGTAGAGCCATAGCCACCACCGTAGTATCTCTGTTCATTGAGC

CAACGCACGACGGGAGGCACAAAGTCAAAGTCTTTTAGCTGCAGTAGGGCCAAGAGGGCATAGGATGTGGCCTCC

ACATTGTAGAGCTGCTGACCAGGCTCCTCCCAGCGGTTCTTATCTTTGGCTGTGGTCAGAAATTTGTTGAGAAGA

GGTCCCTTCAGCCTGCCCATCTGGGCCAGGGCATAGGCAGCGATGGCCACAGTGTAGGATCTCTGTAGGTTCATG

TAGTTGGCTTCAAGGAAGTCTCCTGCTTTAGTGATGCTGCCGGGCAGGCTGTTGACCTGCTCCTCGCAAATCTCT

TTAGCCTCTTGCAGCGAGATGAGAACAAAGGCCGTGAGGGCCATGTCTTTCTCGTTGGTGTTCCGGAATCCACCA

GTCATTTCTTGATGTATCACGGGCGCATCCTCCTGGAAGACCCCGTCGGGCTTCTGCTTCTCCAGGATCAGCCAT

TTAACAGCCCCGCAGAGGACCTGGGAGTCGATGGCAATGAGGTTGACAGCCAGAGAAGACCTTGACCACGTAG

GCGGTCAGCCAGGTGCTGGGTGCCCGGTTCAGGAAGGCCGCAAAGGCAGAGCTGGGTTGTCTGAAGGCCAGCTGC

TGGGTGTACCCCTTCTTGATGAGCTCCAAGGCCCCCTGCCGCTTCTCCGGGCCGAACTTCTCCCACTGTTCCGTT

TCATCCAGGTAATGCACAGCGATGACTGTGGGCGTCATGGTGATCATGTTCTGTTCTCCGCAGCCCGAGGGGGTC

ACGATGAGGTGCTTCAGCCGTTCCGCATCGATGGCATCCTCTGTCATCTGGGCCACCGGGGTCCCTTGCAGGAGA

ATTCTGGTCTCAGACTCGGTGTCCGGGACTTGGTCACTGAGGTCTGCAGGTGGGACGTCCTCTCTCTGCACTCCT

TCCTGGCCCAGGCGTTCTGGATCCAGCGTGCGAACAGCCACAGTTTTGTTCATTCTGATTCCTTCCGGCACGACC

TTCAGGGACTTCCTGACACCGTCACTGATGAAAAAATGGTAGACGGCAGCCTTGACTTCCACTTCCTGCTGGCCG

GTCTTTAGGGGCACGATGACATAAGGAACGGACAGCGAGGACTTGGGGGGATGGTTACGGTCTGCTGGTGACGC

CTCTTGGCGGTGGCCAGGCTGCAGAAGGCTGGATTGTGGAGTAGTTCCACCCTCACCTTGAGCTCTTGGTTCTGC

CGGTAATTGTAGAGAACAGCTCGGATTTCCACCTGCTCGTTTCGAACAACAGAGTAGGGTAGCCGCAGGTCGATG

AAGAAGTCCTGCATTACTGTGACCTCGAAGGGGTCTGCCACACAGATCCCTTTCTTGTCTGACAAGCTCACGGCC

AGAATCTCCCACGTGGTGATGGAGTCTTTCAAAAATATATTCATGAGCTTCGTGGAGATTCCGTTTTTCGGTGCC
```

-continued

TCTTTCAACTCTTCAATCTTCCACAGCCAACTCTCTGGGAACTCACTTCGGGAAACGATGTTCTCTTCTGCGATG

ATGTCCTCATCCAGGTTACTCCTGGCCAGGCCCAGGTGACTGGCCCGCGCGTGCTGCCGCCGCAGCTCGGTGATG

TAGTTGCAGCAGTCCAGGAAGGCCTTCTTGCACGCCTCGTCCAGGGTGATGTAACGGGTCCGGCGCTGGCATGAG

AACCTCATGGGGTTCTCCCGCATACCGTGCTCGCAGCACTTGCGCAGCTCCTTGGGGTACTGACCAACTTTGTCC

ATTCTCTTCTCCGCGAGCTGCACGGAACGGCGTCGGCGGGCGGCTGGCTGTGGGCACTGAAGTTCTGCCCTCTGG

GCCGTCTGCTGGCCACTGCTGCTCGCAAAGGTCAGGCCTGCATCCGAGAAGACACCAGCGTAATCCTTCCCACTG

CCTGGGGTGCAGCCGATGTCTGCCTTCTCCACCACGTCCCAGATCTTACTCTGCGTCAGCTTGTTCTTCTTATTC

AGCACAAACACGCCCTTGTCCACAGCCACCAGTCCCACCCGGGCCCCGTGGTCACCCTCTATCTTCAGGGTCATC

TGCTGCCCGGGTAAAGGCTGCCTGTCTTCTGACTGGCCGCTTTTTACCACCAGCGAGCCCACGCAAGAGTCCTTG

ACGTCCACCCACACGGAGTCGGCCACCACTTCCCTCTGGCCGTTGGCGCCGATCAGCGTGTAGTAGGCCACCAGG

CGGAAGGAAGGGATGAAGTCGGTGGTGATGGACAGGGGCAGCACCACCAGGTCCTGGCCAGGCTCTCGCACCTGG

CGTCCCACCTTCAACAGCTTGCCTTTGTTCATAATCAGGTAGGTGTAGTAGCGGATCTTGGCCTCCTGGGTGCGG

TCCATTCGCAGGAGGAAGTTGACGTTGAGGGTCTCCCCAGGTCTGAGCTCTGCACGTGGCACTGAGAGATGCAGG

TAATTGTTGGAGTTGCCCACGGTGCTGTAGGGCTGAGCCTCCATGGTCCTGGTAGCCTGCTCCGCCTCCGAGAGC

TCCCGCTTCTTCGTGCGCACCGTGATGCTCAAGGGCTTCTGGCTGGGGTGTGTGTTGATGCTGAGTTTGGCCACG

CCGTCTCCCTGGGTTAGAGACTGCACAGCGTCCTCGCCCTGGACTGCCACGGGGACTCGGTAGGCTGGAGAGCCA

TCGGGGTTCGTCACGAACACCATGAGGTCAAAGGGCATTCCTGGTTTGAAGTACTTGGGCGTCTTGGTGAAGTGG

ATCTGGTAGGGAGAGGTCACGATGGGGATCCCGCTGCGCTCCGCCTGCACCATGTCACTGCCTGAGTGCAGGATA

ACGGTGACAGACACATACAAGGACTTCCCCACTAGGTCTTCCGGTCGGGGATTCTGCACCCCGTCCAGCAGTACC

TTCCGGCTCAGCACGGCGTCTCCTGAGCCATCCTCAATCTGGATGCGCTTGAGGGATTCAGGCAGGGAAATCCTC

TGCTCGCCATCCTGGATCCCGAAGATGACAAAGGCAGTTCCCTCCACTTTCTTTCCATAGAGGAACCTGGCGGTG

ATGGTGACCTCCAGGCCCTTCTGGTTATAGATGTAGTAGAATTTCTCTGTAGGCTCCACTATGACCTCGAAACTG

GGCAGCACGTACTCCTTCACCTCAAACTCAGTGGAGAAGACCTGTTGCGGCGAATTTTCATAGTAGGCTCGGATC

TTCCACTGGCCCATGTTGACGAGTTCCGGAATGTCCCAAGACAAGGGCAAGATGCCAAATTGGTTCTGAGAAGAC

AAGGAGTCCTGCTTGACCGGGATGCCGTCCGGGTTCTCAATGTTGACCACGACCGTCCGGCCCACGGGTAGCAGC

TTGTGGTTGACGGTGAAGATCCGACAGAGAACTGTGGAGCCAGGGGTGTAGATGGTCTTGTCTGTCTGGATGAAG

AGGTACCCGCTCTGAAGGCTGACCAGTACCACCTTCTCCACCACTTGGGCCCCGAAGGTGGCCTGCACAGTCACG

AACTTGTTGTGCCCCTTTTCTGACTTGAACTCCTTGTTGGCTGGGATCCTGATGGTGACGCTGCCCATGTGGCTG

GTGGCAGGGGTCAGCACGGTCTTCTCACTGGACAGCACCAGTTTTTTGCCTGGGAAGTCGTGGACAGTGACAGTG

ACCGGAACATCCCCATTCGCGTCATGGGCCTCCAGCACCACGGTCTCCTCACTCTCCAGCCGCAAGACGTTTGGG

GTGATCATAGAGTACATGGGAGTCCCCAGAGCCAGGGGAGGTGGATTAGTAGCAGGAGCAGCAGGCTGGGACCT

GAGGTGAGTCCCATGGTGCTGGGACAGTGCAGGGTCAGAGGGACAGAGGGACAGAGGGAGAGGATGGGGAGGAGT

GAGCAGTGACTGCTGGAGTTGGCTTT

SEQUENCE LISTING (1641 sequences)

SEQ ID NO: 1 - DNA, 5148 bp, Homo sapiens
agataaaaagccagctccagcaggcgctgctcactcctccccatcctctccctctgtccctctgtccctctgaccctgcactgtcccagcaccatgggacccacctcaggtcccagcctgctgctcctgctactaacccacctccccctggctctggggagtcccatgtactctatcatcacccccaacatcttgcggctggagagcgaggagaccatggtgctggaggcccacgacgcgcaaggggatgttccagtcactgttactgtccacgacttcccaggcaaaaaactagtgctgtccagtgagaagactgtgctgacccctgccaccaaccacatgggcaacgtcaccttcacgatcccagccaacagggagttcaagtcagaaaaggggcgcaacaagttcgtgaccgtgcaggccaccttcgggacccaagtggtggagaaggtggtgctggtcagcctgcagagcgggtacctcttcatccagacagacaagaccatctacacccctggctccacagttctctatcggatcttcaccgtcaaccacaagctgctacccgtgggccggacggtcatggtcaacattgagaacccggaaggcatcccggtcaagcaggactccttgtcttctcagaaccagcttggcgtcttgcccttgtcttgggacattccggaactcgtcaacatgggccagtggaagatccgagcctactatgaaaactcaccacagcaggtcttctccactgagtttgaggtgaaggagtacgtgctgcccagtttcgaggtcatagtggagcctacagagaaattctactacatctataacgagaagggcctggaggtcaccatcaccgccaggttcctctacgggaagaaagtggagggaactgcctttgtcatcttcgggatccaggatggcgaacagaggatttccctgcctgaatccctcaagcgcattccgattgaggatggctcgggggaggttgtgctgagccggaaggtactgctggacggggtgcagaacccccgagcagaagacctggtggggaagtctttgtacgtgtctgccaccgtcatcttgcactcaggcagtgacatggtgcaggcagagcgcagcgggatccccatcgtgacctctccctaccagatccacttcaccaagacacccaagtacttcaaaccaggaatgccctttgacctcatggtgttcgtgacgaaccctgatggctctccagcctaccgagtccccgtggcagtccagggcgaggacactgtgcagtctctaacccagggagatggcgtggccaaactcagcatcaacacacaccccagccagaagcccttgagcatcacggtgcgcacgaagaagcaggagctctcggaggcagagcaggctaccaggaccatgcaggctctgccctacagcaccgtgggcaactccaacaattacctgcatctctcagtgctacgtacagagctcagacccggggagaccctcaacgtcaacttcctcctgcgaatggaccgcgcccacgaggccaagatccgctactacacctacctgatcatgaacaagggcaggctgttgaaggcgggacgccaggtgcgagagcccggccaggacctggtggtgctgcccctgtccatcaccaccgacttcatcccttccttccgcctggtggcgtactacacgctgatcggtgccagcggccagagggaggtggtggccgactccgtgtgggtggacgtcaaggactcctgcgtgggctcgctggtggtaaaaagcggccagtcagaagaccggcagcctgtacctgggcagcagatgaccctgaagatagagggtgaccacggggcccgggtggtactggtggccgtggacaagggcgtgttcgtgctgaataagaagaacaaactgacgcagagtaagatctgggacgtggtggagaaggcagacatcggctgcaccccgggcagtgggaaggattacgccggtgtcttctccgacgcagggctgaccttcacgagcagcagtggccagcagaccgcccagagggcagaacttcagtgcccgcagccagccgcccgccgacgccgttccgtgcagctcacggagaagcgaatggacaaagtcggcaagtaccccaaggagctgcgcaagtgctgcgaggacggcatgcgggagaaccccatgaggttctcgtgccagcgccggacccgtttcatctccctgggcgaggcgtgcaagaaggtcttcctggactgctgcaactacatcacagagctgcggcggcagcacgcgcgggccagccacctgggcctggccaggagtaacctggatgaggacatcattgcagaagagaacatcgtttcccgaagtgagttcccagagagctggctgtggaacgttgaggacttgaaagagccaccgaaaaatggaatctctacgaagctcatgaatatatttttgaaagactccatcaccacgtgggagattctggctgtgagcatgtcggacaagaaagggatctgtgtggcagaccccttcgaggtcacagtaatgcaggacttcttcatcgacctgcggctaccctactctgttgttcgaaacgagcaggtggaaatccgagccgttctctacaattaccggcagaaccaagagctcaaggtgagggtggaactactccacaatccagccttctgcagcctggccaccaccaagaggcgtcaccagcagaccgtaaccatcccccccaagtcctcgttgtccgttccatatgtcatcgtgccgctaaagaccggcctgcaggaagtggaagtcaaggctgctgtctaccatcatttcatcagtgacggtgtcaggaagtccctgaaggtcgtgccggaaggaatcagaatgaacaaaactgtggctgttcgcaccctggatccagaacgcctgggccgtgaaggagtgcagaaagaggacatcccacctgcagacctcagtgaccaagtcccggacaccgagtctgagaccagaattctcctgcaagggaccccagtggcccagatgacagaggatgccgtcgacgcggaacggctgaagcacctcattgtgaccccctcgggctgcggggaacagaacatgatcggcatgacgcccacggtcatcgctgtgcattacctggatgaaacggagcagtgggagaagttcggcctagagaagcggcagggggccttggagctcatcaagaaggggtacacccagcagctggccttcagacaacccagctctgcctttgcggccttcgtgaaacgggcacccagcacctggctgaccgcctacgtggtcaaggtcttctctctggctgtcaacctcatcgccatcgactcccaagtcctctgcggggctgttaaatggctgatcctggagaagcagaagcccgacggggtcttccaggaggatgcgcccgtgatacaccaagaaatgattggtggattacggaacaacaacgagaaagacatggccctcacggcctttgttctcatctcgctgcaggaggctaaagatatttgcgaggagcaggtcaacagcctgccaggcagcatcactaaagcaggagacttccttgaagccaactacatgaacctacagagatcctacactgtggccattgctggctatgctctggcccagatgggcaggctgaaggggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcccgaggaggacgaatgccaagacgaagagaaccagaaacaatgccaggacctcggcgccttcaccgagagcatggttgtctttgggtgccccaactgaccacacccccattcccccactccagataaagcttcagttatatctcaaaaaaaaaaaaaaaaa

SEQ ID NO: 2 - DNA, 5148 bp, Homo sapiens; identical to SEQ ID NO: 1

SEQ ID NO: 3 - DNA, 5139 bp, Mus musculus
agagaggagagccatataaagagccagcggctacagccccagctcgcctctgcccacccctgccccttaccccttcattccttccacctttttccttcactatgggaccagcttcagggtcccagctactagtgctactgctgctgttggccagctccccattagctctggggatccccatgtattccatcattactcccaatgtcctacggctggagagcgaagagaccatcgtactggaggcccacgatgctcagggtgacatcccagtcacagtcactgtgcaagacttcctaaagaggcaagtgctgaccagtgagaagacagtgttgacaggagccagtggacatctgagaagcgtctccatcaagattccagccagtaaggaattcaactcagataaggaggggcacaagtacgtgacagtggtggcaaacttcggggaaacggtggtggagaaagcagtgatggtaagcttccagagtgggtacctcttcatccagacagacaagaccatctacacccctggctccactgtcttatatcggatcttcactgtggacaacaacctactgcccgtgggcaagacagtcgtcatcctcattgagacccccgatggcattcctgtcaagagagacattctgtcttccaacaaccaacacggcatcttgcctttgtcttggaacattcctgaactggtcaacatggggcagtggaagatccgagccttttacgaacatgcgccgaagcagatcttctccgcagagtttgaggtgaaggaatacgtgctgcccagttttgaggtccgggtggagcccacagagacattttattacatcgatgacccaaatggcctggaagtttccatcatagccaagttcctgtacgggaaaaacgtggacgggacagccttcgtgatttttggggtccaggatggcgataagaagatttctctggcccactccctcacgcgcgtagtgattgaggatggtgtgggggatgcagtgctgacccggaaggtgctgatggagggggtacggccttccaacgccgacgccctggtggggaagtccctgtatgtctccgtcactgtcatcctgcactcaggtagtgacatggtagaggcagagcgcagtgggatcccgattgtcacttccccgtaccagatccacttcaccaagacacccaaattcttcaagccagccatgccctttgacctcatggtgttcgtgaccaaccccgatggctctccggccagcaaagtgctggtggtcactcagggatctaatgcaaaggctctcacccaagatgatggcgtggccaagctaagcatcaacacacccaacagccgccaacccctgaccatcacagtccgcaccaagaaggacactctcccagaatcacggcaggccaccaagacaatggaggcccatccctacagcactatgcacaactccaacaactacctacacttgtcagtgtcacgaatggagctcaagccgggggacaacctcaatgtcaacttccacctgcgcacagacccaggccatgaggccaagatccgatactacacctacctggttatgaacaaggggaagctcctgaaggcaggccgccaggttcgggagcctggccaggacctggtggtcttgtccctgcccatcactccagagtttattccttcatttcgcctggtggcttactacaccctgattggagctagtggccagagggaggtggtggctgactctgtgtgggtggatgtgaaggattcctgtattggcacgctggtggtgaagggtgacccaagagataaccatctcgcacctgggcaacaaacgacactcaggattgaaggaaaccagggggcccgagtggggctagtggctgtggacaagggagtgtttgtgctgaacaagaagaacaaactcacacagagcaagatctgggatgtggtagagaaggcagacattggctgcaccccaggcagtgggaagaactatgctggtgtcttcatggatgcaggcctggccttcaagacaagccaaggactgcagactgaacagagagcagatcttgagtgcaccaagccagcagcccgccgccgtcgctcagtacagttgatggaaagaaggatggacaaagctggtcagtacactgacaagggtcttcggaagtgttgtgaggatggtatgcgggatatccctatgagatacagctgccagcgccgggcacgcctcatcacccagggcgagaactgcataaaggccttcatagactgctgcaaccacatcaccaagctgcgtgaacaacacagaagagaccacgtgctgggcctggccaggagtgaattggaggaagacataattccagaagaagatattatctctagaagccacttcccacagagctggttgtggaccatagaagagttgaaagaaccagagaaaaatggaatctctacgaaggtcatgaacatctttctcaaagattccatcaccacctgggagattctggcagtgagcttgtcagacaagaaagggatctgtgtggcagacccctatgagatcagagtgatgcaggacttcttcattgacctgcggctgccctactctgtagtgcgcaacgaacaggtggagatcagagctgtgctcttcaactaccgtgaacaggaggaacttaaggtgagggtggaactgttgcataatccagccttctgcagcatggccaccgccaagaatcgctacttccagaccatcaaaatccctcccaagtcctcggtggctgtaccgtatgtcattgtccccttgaagatcggccaacaagaggtggaggtcaaggctgctgtcttcaatcacttcatcagtgatggtgtcaagaagacactgaaggtcgtgccagaaggaatgagaatcaacaaaactgtggccatccatacactggacccagagaagctcggtcaagggggagtgcagaaggtggatgtgcctgccgcagaccttagcgaccaagtgccagacacagactctgagaccagaattatcctgcaagggagcccggtggttcagatggctgaagatgctgtggacggggagcggctgaaacacctgatcgtgacccccgcaggctgtggggaacagaacatgattggcatgacaccaacagtcattgcggtacactacctggaccagaccgaacagtgggagaagttcggcatagagaagaggcaagaggccctggagctcatcaagaaagggtacacccagcagctggccttcaaacagcccagctctgcctatgctgccttcaacaaccggccccccagcacctggctgacagcctacgtggtcaaggtcttctctctagctgccaacctcatcgccatcgactctcacgtcctgtgtggggctgttaaatggttgattctggagaaacagaagccggatggtgtctttcaggaggatgggcccgtgattcaccaagaaatgattggtggcttccggaacgccaaggaggcagatgtgtcactcacagccttcgtcctcatcgcactgcaggaagccagggacatctgtgaggggcaggtcaatagccttcctgggagcatcaacaaggcaggggagtatattgaagccagttacatgaacctgcagagaccatacacagtggccattgctgggtatgccctggccctgatgaacaaactggaggaaccttacctcggcaagtttctgaacacagccaaagatcggaaccgctgggaggagcctgaccagcagctctacaacgtagaggccacatcctacgccctcctggccctgctgctgctgaaagactttgactctgtgccccctgtagtgcgctggctcaatgagcaaagatactacggaggcggctatggctccacccaggctaccttcatggtattccaagccttggcccaatatcaaacagatgtccctgaccataaggacttgaacatggatgtgtccttccacctccccagccgtagctctgcaaccacgtttcgcctgctctgggaaaatggcaacctcctgcgatcggaagagaccaagcaaaatgaggccttctctctaacagccaaaggaaaaggccgaggcacattgtcggtggtggcagtgtatcatgccaaactcaaaagcaaagtcacctgcaagaagtttgacctcagggtcagcataagaccagcccctgagacagccaagaagcccgaggaagccaagaataccatgttccttgaaatctgcaccaagtacttgggagatgtggacgccactatgtccatcctggacatctccatgatgactggctttgctccagacacaaaggacctggaactgctggcctctggagtagatagatacatctccaagtacgagatgaacaaagccttctccaacaagaacaccctcatcatctacctagaaaagatttcacacaccgaagaagactgcctgaccttcaaagttcaccagtactttaatgtgggacttatccagcccgggtcggtcaaggtctactcctattacaacctcgaggaatcatgcacccggttctatcatccagagaaggacgatgggatgctcagcaagctgtgccacagtgaaatgtgccggtgtgctgaagagaactgcttcatgcaacagtcacaggagaagatcaacctgaatgtccggctagacaaggcttgtgagcccggagtcgactatgtgtacaagaccgagctaaccaacatagagctgttggatgattttgatgagtacaccatgaccatccagcaggtcatcaagtcaggctcagatgaggtgcaggcagggcagcaacgcaagttcatcagccacatcaagtgcagaaacgccctgaagctgcagaaagggaagaagtacctcatgtggggcctctcctctgacctctggggagaaaagcccaacaccagctacatcattgggaaggacacgtgggtggagcactggcctgaggcagaagaatgccaggatcagaagtaccagaaacagtgcgaagaacttggggcattcacagaatctatggtggtttatggttgtcccaactgactacagcccagccctctaataaagcttcagttgtatttcacccatc

SEQ ID NO: 4 - DNA, 5139 bp, Mus musculus
gatgggtgaaatacaactgaagctttattagagggctgggctgtagtcagttgggacaaccataaaccaccatagattctgtgaatgccccaagttcttcgcactgtttctggtacttctgatcctggcattcttctgcctcaggccagtgctccacccacgtgtccttcccaatgatgtagctggtgttgggcttttctccccagaggtcagaggagaggccccacatgaggtacttcttccctttctgcagcttcagggcgtttctgcacttgatgtggctgatgaacttgcgttgctgccctgcctgcacctcatctgagcctgacttgatgacctgctggatggtcatggtgtactcatcaaaatcatccaacagctctatgttggttagctcggtcttgtacacatagtcgactccgggctcacaagccttgtctagccggacattcaggttgatcttctcctgtgactgttgcatgaagcagttctcttcagcacaccggcacatttcactgtggcacagcttgctgagcatcccatcgtccttctctggatgatagaaccgggtgcatgattcctcgaggttgtaataggagtagaccttgaccgacccgggctggataagtcccacattaaagtactggtgaactttgaaggtcaggcagtcttcttcggtgtgtgaaatcttttctaggtagatgatgagggtgttcttgttggagaaggctttgttcatctcgtacttggagatgtatctatctactccagaggccagcagttccaggtcctttgtgtctggagcaaagccagtcatcatggagatgtccaggatggacatagtggcgtccacatctcccaagtacttggtgcagatttcaaggaacatggtattcttggcttcctcgggcttcttggctgtctcaggggctggtcttatgctgaccctgaggtcaaacttcttgcaggtgactttgcttttgagtttggcatgatacactgccaccaccgacaatgtgcctcggccttttcctttggctgttagagagaaggcctcattttgcttggtctcttccgatcgcaggaggttgccattttcccagagcaggcgaaacgtggttgcagagctacggctggggaggtggaaggacacatccatgttcaagtccttatggtcagggacatctgtttgatattgggccaaggcttggaataccatgaaggtagcctgggtggagccatagccgcctccgtagtatctttgctcattgagccagcgcactacagggggcacagagtcaaagtctttcagcagcagcagggccaggagggcgtaggatgtggcctctacgttgtagagctgctggtcaggctcctcccagcggttccgatctttggctgtgttcagaaacttgccgaggtaaggttcctccagtttgttcatcagggccagggcatacccagcaatggccactgtgtatggtctctgcaggttcatgtaactggcttcaatatactcccctgccttgttgatgctcccaggaaggctattgacctgcccctcacagatgtccctggcttcctgcagtgcgatgaggacgaaggctgtgagtgacacatctgcctccttggcgttccggaagccaccaatcatttcttggtgaatcacgggcccatcctcctgaaagacaccatccggcttctgtttctccagaatcaaccatttaacagccccacacaggacgtgagagtcgatggcgatgaggttggcagctagagagaagaccttgaccacgtaggctgtcagccaggtgctggggggccggttgttgaaggcagcataggcagagctgggctgtttgaaggccagctgctgggtgtaccctttcttgatgagctccagggcctcttgcctcttctctatgccgaacttctcccactgttcggtctggtccaggtagtgtaccgcaatgactgttggtgtcatgccaatcatgttctgttccccacagcctgcgggggtcacgatcaggtgtttcagccgctccccgtccacagcatcttcagccatctgaaccaccgggctcccttgcaggataattctggtctcagagtctgtgtctggcacttggtcgctaaggtctgcggcaggcacatccaccttctgcactcccccttgaccgagcttctctgggtccagtgtatggatggccacagttttgttgattctcattccttctggcacgaccttcagtgtcttcttgacaccatcactgatgaagtgattgaagacagcagccttgacctccacctcttgttggccgatcttcaaggggacaatgacatacggtacagccaccgaggacttgggagggattttgatggtctggaagtagcgattcttggcggtggccatgctgcagaaggctggattatgcaacagttccaccctcaccttaagttcctcctgttcacggtagttgaagagcacagctctgatctccacctgttcgttgcgcactacagagtagggcagccgcaggtcaatgaagaagtcctgcatcactctgatctcataggggtctgccacacagatccctttcttgtctgacaagctcactgccagaatctcccaggtggtgatggaatctttgagaaagatgttcatgaccttcgtagagattccatttttctctggttctttcaactcttctatggtccacaaccagctctgtgggaagtggcttctagagataatatcttcttctggaattatgtcttcctccaattcactcctggccaggcccagcacgtggtctcttctgtgttgttcacgcagcttggtgatgtggttgcagcagtctatgaaggcctttatgcagttctcgccctgggtgatgaggcgtgcccggcgctggcagctgtatctcatagggatatcccgcataccatcctcacaacacttccgaagacccttgtcagtgtactgaccagctttgtccatccttctttccatcaactgtactgagcgacggcggcgggctgctggcttggtgcactcaagatctgctctctgttcagtctgcagtccttggcttgtcttgaaggccaggcctgcatccatgaagacaccagcatagttcttcccactgcctggggtgcagccaatgtctgccttctctaccacatcccagatcttgctctgtgtgagtttgttcttcttgttcagcacaaacactcccttgtccacagccactagccccactcgggccccctggtttccttcaatcctgagtgtcgtttgttgcccaggtgcgagatggttatctcttgggtcacccttcaccaccagcgtgccaatacaggaatccttcacatccacccacacagagtcagccaccacctccctctggccactagctccaatcagggtgtagtaagccaccaggcgaaatgaaggaataaactctggagtgatgggcagggacaagaccaccaggtcctggccaggctcccgaacctggcggcctgccttcaggagcttccccttgttcataaccaggtaggtgtagtatcggatcttggcctcatggcctgggtctgtgcgcaggtggaagttgacattgaggttgtcccccggcttgagctccattcgtgacactgacaagtgtaggtagttgttggagttgtgcatagtgctgtagggatgggcctccattgtcttggtggcctgccgtgattctgggagagtgtccttcttggtgcggactgtgatggtcaggggttggcggctgttgggtgtgttgatgcttagcttggccacgccatcatcttgggtgagagcctttgcattagatccctgagtgaccaccagcactttgctggccggagagccatcggggttggtcacgaacaccatgaggtcaaagggcatggctggcttgaagaatttgggtgtcttggtgaagtggatctggtacggggaagtgacaatcgggatcccactgcgctctgcctctaccatgtcactacctgagtgcaggatgacagtgacggagacatacagggacttccccaccagggcgtcggcgttggaaggccgtaccccctccatcagcaccttccgggtcagcactgcatcccccacaccatcctcaatcactacgcgcgtgagggagtgggccagagaaatcttcttatcgccatcctggaccccaaaaatcacgaaggctgtcccgtccacgtttttcccgtacaggaacttggctatgatggaaacttccaggccatttgggtcatcgatgtaataaaatgtctctgtgggctccacccggacctcaaaactgggcagcacgtattccttcacctcaaactctgcggagaagatctgcttcggcgcatgttcgtaaaaggctcggatcttccactgccccatgttgaccagttcaggaatgttccaagacaaaggcaagatgccgtgttggttgttggaagacagaatgtctctcttgacaggaatgccatcgggggtctcaatgaggatgacgactgtcttgcccacgggcagtaggttgttgtccacagtgaagatccgatataagacagtggagccaggggtgtagatggtcttgtctgtctggatgaagaggtacccactctggaagcttaccatcactgctttctccaccaccgtttccccgaagtttgccaccactgtcacgtacttgtgcccctccttatctgagttgaattccttactggctggaatcttgatggagacgcttctcagatgtccactggctcctgtcaacactgtcttctcactggtcagcacttgcctctttaggaagtcttgcacagtgactgtgactgggatgtcaccctgagcatcgtgggcctccagtacgatggtctcttcgctctccagccgtaggacattgggagtaatgatggaatacatggggatccccagagctaatggggagctggccaacagcagcagtagcactagtagctgggaccctgaagctggtcccatagtgaaggaaaaaggtggaaggaatgaaggggtaaggggcaggggtgggcagaggcgagctggggctgtagccgctggctctttatatggctctcctctct

SEQ ID NO: 5 - DNA, 5091 bp, Rattus norvegicus
ctaccccttacccctcactccttccacctttgtcctttaccatgggacccacgtcagggtcccagctactagtgctactgctgctgttggccagctccctgctagctctggggagccccatgtactccatcattactcccaatgtcctgcggctggagagtgaagagactttcatactagaggcccatgatgctcagggtgatgtcccagtcactgtcactgtgcaagacttcctaaagaagcaagtgctgaccagtgagaagacagtgttgacaggagccactggacatctgaacagggtctccatcaagattccagccagtaaggaattcaatgcagataaggggcacaagtacgtgacagtggtggcaaacttcggggcaacagtggtggagaaagcggtgctagtaagctttcagagtggttacctcttcatccagacagacaagaccatctacaccccaggctccactgttttctatcggatcttcactgtggacaacaacctattgcctgtgggcaagacagtcgtcatcgtcattgagaccccggacggcgttcccatcaagagagacattctatcttcccacaaccaatatggcatcttgcctttgtcttggaacattccagaactggtcaacatggggcagtggaagatccgagccttctatgaacatgcaccaaagcagaccttctctgcagagtttgaggtgaaggaatacgtgctgcccagtttcgaagtcctggtggagcctacagagaaattttattacatcgatgacccaaagggcctggaagtttccatcacagccagattcctgtatgggaagaacgtggacgggacagctttcgtgatctttggggtccaggatgaggataagaagatttctctggcccagtccctcacccgcgtgctgatcgaggatggttcaggggaggcagtgctcagccgaaaagtgctgatggacggggtacggccctccagcccagaagccctagtggggaagtccctgtacgtctctgtcactgttatcctgcactcaggtagcgacatggtagaggcagagcgcagtgggatcccaattgtcacttccccgtaccagatccacttcaccaagacacccaaattcttcaagccagccatgcctttcgacctcatggtgtttgtgaccaaccctgatggctctccagcccgcagagtgccagtagtcactcagggatccgacgcgcaggctctcacccaggatgatggtgtggccaagctgagcgtcaacacacccaacaaccgccaacccctgactatcacggtccgcaccaagaaggagggtatcccggacgcgcggcaggccaccaggacgatgcaggcccagccctacagcactatgcacaattccaacaactacctgcacttgtcagtgtctcgggtggagctcaagcctggggacaacctcaatgtcaacttccacctgcgcacggacgctggccaagaggccaagatccgatactacacctatctggttatgaacaaggggaagttactgaaggcaggccgtcaggttcgggagcctggccaggacctggtggtcttgtcactgcccatcactccagaatttataccttccttccgcctggtggcttactacaccctgattggagctaatggccaaagggaggtggtggccgactcagtgtgggtggatgtgaaggactcctgtgtaggcacgctggtggtgaaaggtgacccaagagataaccgacagcccgcgcctgggcatcaaacgacactaaggatcgaggggaaccagggggcccgagtggggctagtggctgtggacaagggggtgtttgtgctgaacaagaagaacaaactcacacagagcaagatctgggatgtagtagagaaggcagacattggctgcaccccaggcagtgggaagaactatgcgggtgtcttcatggatgctggcctgaccttcaagacaaaccaaggcctgcagactgatcagagagaagatcctgagtgcgccaagccagctgcccgccgccgtcgctcagtgcagttgatggaaaggaggatggacaaagctggtcagtacaccgacaagggtctgcggaagtgttgtgaggatggcatgcgtgatatccctatgaagtacagctgccagcgccgggctcgcctcatcacccagggcgagagctgcctgaaggccttcatggactgctgcaactatatcaccaagcttcgtgagcagcacagaagagaccatgtgctgggcctggccaggagtgatgtggatgaagacataatcccagaagaagatattatctctagaagccacttcccagagagctggttgtggaccatagaagagttgaaagaaccagagaaaaatggaatctctacgaaggtcatgaacatctttctcaaagattccatcaccacctgggagattctggcagtgagcttgtccgacaagaaagggatctgtgtggcagacccctatgagatcacagtgatgcaggacttcttcattgacctgcgactgccctactctgtggtgcgcaatgaacaggtggagatcagagctgtgctcttcaattaccgtgaacaggagaaacttaaggtaagggtggaactgttgcataacccagccttctgcagcatggccactgccaagaagcggtactaccagaccatcgaaatccctcccaagtcctctgtggctgtgccttatgtcattgtccccttgaagatcggcctccaggaggtggaggtcaaggccgccgtcttcaaccacttcatcagtgatggtgtcaagaagatactgaaggtcgtgccagaaggaatgagagtcaacaaaactgtggctgtccgtacactggatccagaacacctcggtcaagggggagtgcagagggaggatgtacctgcagcagacctcagtgaccaagtgccagacacagattctgagaccagaattctcctgcaagggaccccggtggctcagatggccgaggacgctgtggacggggagcggctgaaacacctgatcgtgaccccctctggctgtggggagcagaacatgattggcatgacacccacggtcattgcagtacactatctggatcagaccgaacagtgggagaaattcggcctagagaagaggcaagaagctctggagctcatcaagaaagggtacacccagcagctggctttcaaacagcccagctctgcctatgctgccttcaacaaccggcctcccagcacctggctgacagcctatgtggtcaaggtcttctctctggctgccaacctcatcgccatcgactctcaggtcctgtgtggggctgtcaaatggctgattctggagaaacagaagccagatggtgtctttcaggaggacggaccagtgattcaccaagaaatgattggtggcttccggaacaccaaggaggcagatgtgtcgcttacagcctttgtcctcatcgcactgcaggaagccagagatatctgtgaggggcaggtcaacagccttcccgggagcatcaacaaggcaggggagtatcttgaagccagttacctgaacctgcagagaccatacacagtagccattgctgggtatgccctggccctgatgaacaaactggaggaaccttacctcaccaagtttctgaacacagccaaagatcggaaccgctgggaggagcctggccagcagctctacaatgtggaggccacctcctacgccctcctggccctgctgctgctgaaagactttgactctgtgcctcctgtggtgcgctggctcaacgagcaaagatactacggaggtggctatggctccacgcaggctaccttcatggtattccaagccttggctcaataccaaacagatgtccctgaccacaaggacttgaacatggatgtgtccctccacctccccagccgcagctccccaactgtgtttcgcctgctatgggaaagtggcagtctcctgagatcagaagagaccaagcagaatgagggcttttctctgacagccaaaggaaaaggccaaggcacactgtcggtggtgacagtgtatcacgccaaagtcaaaggcaaagccacctgcaagaagtttgacctcagggtcaccataaaaccagcccctgagacagccaagaagccccaggatgccaagagttctatgatccttgacatctgcaccaggtacttgggagacgtggatgctactatgtccatcctggacatctccatgatgactggctttattccagacacaaacgacctggaactgctgagctctggagtagacagatacatttccaagtatgagatggacaaagccttctccaacaagaacaccctcatcatctacctagaaaagatctcacactccgaagaagactgcctgtccttcaaagtccaccagttctttaacgtgggacttatccagccggggtcggtcaaggtctactcctactacaatctagaggagtcatgcacccggttctatcatccggagaaggacgatggaatgctgagcaagctgtgccacaatgaaatgtgccgctgtgcagaggagaactgcttcatgcatcagtcacaggatcaggtcagcctgaatgaacgactagacaaggcttgtgagcctggagtggactacgtgtacaagaccaagctaacgacgatagagctgtcggatgattttgatgagtacatcatgaccatcgagcaggtcatcaagtcaggctcagatgaggtgcaggcaggtcaggaacgaaggttcatcagccacgtcaagtgcagaaacgccctaaagctgcagaaagggaagcagtacctcatgtggggcctctcctccgacctctggggagaaaagcccaataccagctacatcattgggaaggacacgtgggtggagcactggcccgaggcagaggaatgtcaggatcagaagaaccagaaacagtgcgaagacctcggggcattcacagaaacaatggtggttttcggctgccccaactgaccacaacctccaataaagcttcagttgtattttacccatcaaaaaaaaaaaaaaaaaa

SEQ ID NO: 6 - DNA, 5091 bp, Rattus norvegicus
ttttttttttttttttttgatgggtaaaatacaactgaagctttattggaggttgtggtcagttggggcagccgaaaaccaccattgtttctgtgaatgccccgaggtcttcgcactgtttctggttcttctgatcctgacattcctctgcctcgggccagtgctccacccacgtgtccttcccaatgatgtagctggtattgggcttttctccccagaggtcggaggagaggccccacatgaggtactgcttccctttctgcagctttagggcgtttctgcacttgacgtggctgatgaaccttcgttcctgacctgcctgcacctcatctgagcctgacttgatgacctgctcgatggtcatgatgtactcatcaaaatcatccgacagctctatcgtcgttagcttggtcttgtacacgtagtccactccaggctcacaagccttgtctagtcgttcattcaggctgacctgatcctgtgactgatgcatgaagcagttctcctctgcacagcggcacatttcattgtggcacagcttgctcagcattccatcgtccttctccggatgatagaaccgggtgcatgactcctctagattgtagtaggagtagaccttgaccgaccccggctggataagtcccacgttaaagaactggtggactttgaaggacaggcagtcttcttcggagtgtgagatcttttctaggtagatgatgagggtgttcttgttggagaaggctttgtccatctcatacttggaaatgtatctgtctactccagagctcagcagttccaggtcgtttgtgtctggaataaagccagtcatcatggagatgtccaggatggacatagtagcatccacgtctcccaagtacctggtgcagatgtcaaggatcatagaactcttggcatcctggggcttcttggctgtctcaggggctggttttatggtgaccctgaggtcaaacttcttgcaggtggctttgcctttgactttggcgtgatacactgtcaccaccgacagtgtgccttggccttttcctttggctgtcagagaaaagccctcattctgcttggtctcttctgatctcaggagactgccactttcccatagcaggcgaaacacagttggggagctgcggctggggaggtggagggacacatccatgttcaagtccttgtggtcagggacatctgtttggtattgagccaaggcttggaataccatgaaggtagcctgcgtggagccatagccacctccgtagtatctttgctcgttgagccagcgcaccacaggaggcacagagtcaaagtctttcagcagcagcagggccaggagggcgtaggaggtggcctccacattgtagagctgctggccaggctcctcccagcggttccgatctttggctgtgttcagaaacttggtgaggtaaggttcctccagtttgttcatcagggccagggcatacccagcaatggctactgtgtatggtctctgcaggttcaggtaactggcttcaagatactcccctgccttgttgatgctcccgggaaggctgttgacctgcccctcacagatatctctggcttcctgcagtgcgatgaggacaaaggctgtaagcgacacatctgcctccttggtgttccggaagccaccaatcatttcttggtgaatcactggtccgtcctcctgaaagacaccatctggcttctgtttctccagaatcagccatttgacagccccacacaggacctgagagtcgatggcgatgaggttggcagccagagagaagaccttgaccacataggctgtcagccaggtgctgggaggccggttgttgaaggcagcataggcagagctgggctgtttgaaagccagctgctgggtgtaccctttcttgatgagctccagagcttcttgcctcttctctaggccgaatttctcccactgttcggtctgatccagatagtgtactgcaatgaccgtgggtgtcatgccaatcatgttctgctccccacagccagagggggtcacgatcaggtgtttcagccgctccccgtccacagcgtcctcggccatctgagccaccggggtcccttgcaggagaattctggtctcagaatctgtgtctggcacttggtcactgaggtctgctgcaggtacatcctccctctgcactcccccttgaccgaggtgttctggatccagtgtacggacagccacagttttgttgactctcattccttctggcacgaccttcagtatcttcttgacaccatcactgatgaagtggttgaagacggcggccttgacctccacctcctggaggccgatcttcaaggggacaatgacataaggcacagccacagaggacttgggagggatttcgatggtctggtagtaccgcttcttggcagtggccatgctgcagaaggctgggttatgcaacagttccacccttaccttaagtttctcctgttcacggtaattgaagagcacagctctgatctccacctgttcattgcgcaccacagagtagggcagtcgcaggtcaatgaagaagtcctgcatcactgtgatctcataggggtctgccacacagatccctttcttgtcggacaagctcactgccagaatctcccaggtggtgatggaatctttgagaaagatgttcatgaccttcgtagagattccatttttctctggttctttcaactcttctatggtccacaaccagctctctgggaagtggcttctagagataatatcttcttctgggattatgtcttcatccacatcactcctggccaggcccagcacatggtctcttctgtgctgctcacgaagcttggtgatatagttgcagcagtccatgaaggccttcaggcagctctcgccctgggtgatgaggcgagcccggcgctggcagctgtacttcatagggatatcacgcatgccatcctcacaacacttccgcagacccttgtcggtgtactgaccagctttgtccatcctcctttccatcaactgcactgagcgacggcggcgggcagctggcttggcgcactcaggatcttctctctgatcagtctgcaggccttggtttgtcttgaaggtcaggccagcatccatgaagacacccgcatagttcttcccactgcctggggtgcagccaatgtctgccttctctactacatcccagatcttgctctgtgtgagtttgttcttcttgttcagcacaaacacccccttgtccacagccactagccccactcgggccccctggttcccctcgatccttagtgtcgtttgatgcccaggcgcgggctgtcggttatctcttgggtcacctttcaccaccagcgtgcctacacaggagtccttcacatccacccacactgagtcggccaccacctccctttggccattagctccaatcagggtgtagtaagccaccaggcggaaggaaggtataaattctggagtgatgggcagtgacaagaccaccaggtcctggccaggctcccgaacctgacggcctgccttcagtaacttccccttgttcataaccagataggtgtagtatcggatcttggcctcttggccagcgtccgtgcgcaggtggaagttgacattgaggttgtccccaggcttgagctccacccgagacactgacaagtgcaggtagttgttggaattgtgcatagtgctgtagggctgggcctgcatcgtcctggtggcctgccgcgcgtccgggataccctccttcttggtgcggaccgtgatagtcaggggttggcggttgttgggtgtgttgacgctcagcttggccacaccatcatcctgggtgagagcctgcgcgtcggatccctgagtgactactggcactctgcgggctggagagccatcagggttggtcacaaacaccatgaggtcgaaaggcatggctggcttgaagaatttgggtgtcttggtgaagtggatctggtacggggaagtgacaattgggatcccactgcgctctgcctctaccatgtcgctacctgagtgcaggataacagtgacagagacgtacagggacttccccactagggcttctgggctggagggccgtaccccgtccatcagcacttttcggctgagcactgcctcccctgaaccatcctcgatcagcacgcgggtgagggactgggccagagaaatcttcttatcctcatcctggaccccaaagatcacgaaagctgtcccgtccacgttcttcccatacaggaatctggctgtgatggaaacttccaggccctttgggtcatcgatgtaataaaatttctctgtaggctccaccaggacttcgaaactgggcagcacgtattccttcacctcaaactctgcagagaaggtctgctttggtgcatgttcatagaaggctcggatcttccactgccccatgttgaccagttctggaatgttccaagacaaaggcaagatgccatattggttgtgggaagatagaatgtctctcttgatgggaacgccgtccggggtctcaatgacgatgacgactgtcttgcccacaggcaataggttgttgtccacagtgaagatccgatagaaaacagtggagcctggggtgtagatggtcttgtctgtctggatgaagaggtaaccactctgaaagcttactagcaccgctttctccaccactgttgccccgaagtttgccaccactgtcacgtacttgtgccccttatctgcattgaattccttactggctggaatcttgatggagaccctgttcagatgtccagtggctcctgtcaacactgtcttctcactggtcagcacttgcttctttaggaagtcttgcacagtgacagtgactgggacatcaccctgagcatcatgggcctctagtatgaaagtctcttcactctccagccgcaggacattgggagtaatgatggagtacatggggctccccagagctagcagggagctggccaacagcagcagtagcactagtagctgggaccctgacgtgggtcccatggtaaaggacaaaggtggaaggagtgaggggtaaggggtag

SEQ ID NO: 7 - DNA, 5126 bp, Macaca fascicularis
aaagccaactccagcagtcactgctcactcctccccatcctctccctctgtccctctgtccctctgaccctgcactgtcccagcaccatgggactcacctcaggtcccagcctgctgctcctgctactaatccacctccccctggctctggggactcccatgtactctatgatcaccccaaacgtcttgcggctggagagtgaggagaccgtggtgctggaggcccatgacgcgaatggggatgttccggtcactgtcactgtccacgacttcccaggcaaaaaactggtgctgtccagtgagaagaccgtgctgacccctgccaccagccacatgggcagcgtcaccatcaggatcccagccaacaaggagttcaagtcagaaaaggggcacaacaagttcgtgactgtgcaggccaccttcggggcccaagtggtggagaaggtggtactggtcagccttcagagcgggtacctcttcatccagacagacaagaccatctacacccctggctccacagttctctgtcggatcttcaccgtcaaccacaagctgctacccgtgggccggacggtcgtggtcaacattgagaacccggacggcatcccggtcaagcaggactccttgtcttctcagaaccaatttggcatcttgcccttgtcttgggacattccggaactcgtcaacatgggccagtggaagatccgagcctactatgaaaattcgccgcaacaggtcttctccactgagtttgaggtgaaggagtacgtgctgcccagtttcgaggtcatagtggagcctacagagaaattctactacatctataaccagaagggcctggaggtcaccatcaccgccaggttcctctatggaaagaaagtggagggaactgcctttgtcatcttcgggatccaggatggcgagcagaggatttccctgcctgaatccctcaagcgcatccagattgaggatggctcaggagacgccgtgctgagccggaaggtactgctggacggggtgcagaatccccgaccggaagacctagtggggaagtccttgtatgtgtctgtcaccgttatcctgcactcaggcagtgacatggtgcaggcggagcgcagcgggatccccatcgtgacctctccctaccagatccacttcaccaagacgcccaagtacttcaaaccaggaatgccctttgacctcatggtgttcgtgacgaaccccgatggctctccagcctaccgagtccccgtggcagtccagggcgaggacgctgtgcagtctctaacccagggagacggcgtggccaaactcagcatcaacacacaccccagccagaagcccttgagcatcacggtgcgcacgaagaagcgggagctctcggaggcggagcaggctaccaggaccatggaggctcagccctacagcaccgtgggcaactccaacaattacctgcatctctcagtgccacgtgcagagctcagacctggggagaccctcaacgtcaacttcctcctgcgaatggaccgcacccaggaggccaagatccgctactacacctacctgattatgaacaaaggcaagctgttgaaggtgggacgccaggtgcgagagcctggccaggacctggtggtgctgcccctgtccatcaccaccgacttcatcccttccttccgcctggtggcctactacacgctgatcggcgccaacggccagagggaagtggtggccgactccgtgtgggtggacgtcaaggactcttgcgtgggctcgctggtggtaaaaagcggccagtcagaagacaggcagcctttacccgggcagcagatgaccctgaagatagagggtgaccacggggcccgggtgggactggtggctgtggacaagggcgtgtttgtgctgaataagaagaacaagctgacgcagagtaagatctgggacgtggtggagaaggcagacatcggctgcaccccaggcagtgggaaggattacgctggtgtcttctcggatgcaggcctgacctttgcgagcagcagtggccagcagacggcccagagggcagaacttcagtgcccacagccagccgcccgccgacgccgttccgtgcagctcgcggagaagagaatggacaaagttggtcagtaccccaaggagctgcgcaagtgctgcgagcacggtatgcgggagaaccccatgaggttctcatgccagcgccggacccgttacatcaccctggacgaggcgtgcaagaaggccttcctggactgctgcaactacatcaccgagctgcggcggcagcacgcgcgggccagtcacctgggcctggccaggagtaacctggatgaggacatcatcgcagaagagaacatcgtttcccgaagtgagttcccagagagttggctgtggaagattgaagagttgaaagaggcaccgaaaaacggaatctccacgaagctcatgaatatatttttgaaagactccatcaccacgtgggagattctggccgtgagcttgtcagacaagaaagggatctgtgtggcagaccccttcgaggtcacagtaatgcaggacttcttcatcgacctgcggctaccctactctgttgttcgaaacgagcaggtggaaatccgagctgttctctacaattaccggcagaaccaagagctcaaggtgagggtggaactactccacaatccagccttctgcagcctggccaccgccaagaggcgtcaccagcagaccgtaaccatcccccccaagtcctcgctgtccgttccttatgtcatcgtgcccctaaagaccggccagcaggaagtggaagtcaaggctgccgtctaccattttttcatcagtgacggtgtcaggaagtccctgaaggtcgtgccggaaggaatcagaatgaacaaaactgtggctgttcgcacgctggatccagaacgcctgggccaggaaggagtgcagagagaggacgtcccacctgcagacctcagtgaccaagtcccggacaccgagtctgagaccagaattctcctgcaagggaccccggtggcccagatgacagaggatgccatcgatgcggaacggctgaagcacctcatcgtgaccccctcgggctgcggagaacagaacatgatcaccatgacgcccacagtcatcgctgtgcattacctggatgaaacggaacagtgggagaagttcggcccggagaagcggcagggggccttggagctcatcaagaaggggtacacccagcagctggccttcagacaacccagctctgcctttgcggccttcctgaaccgggcacccagcacctggctgaccgcctacgtggtcaaggtcttctctctggctgtcaacctcattgccatcgactcccaggtcctctgcggggctgttaaatggctgatcctggagaagcagaagcccgacggggtcttccaggaggatgcgcccgtgatacatcaagaaatgactggtggattccggaacaccaacgagaaagacatggccctcacggcctttgttctcatctcgctgcaagaggctaaagagatttgcgaggagcaggtcaacagcctgcccggcagcatcactaaagcaggagacttccttgaagccaactacatgaacctacagagatcctacactgtggccatcgctgcctatgccctggcccagatgggcaggctgaagggacctcttctcaacaaatttctgaccacagccaaagataagaaccgctgggaggagcctggtcagcagctctacaatgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggatgtccctgatcacaaggaactgaacctggatgtgtccctccaactgcccagtcgcagctccaagatcatccaccgtatccactgggaatctgccagcctcctgcgatcagaagagaccaaggaaaatgagggtttcacagtcacagctgaaggaaaaggccaaggcaccttgtcggtagtgacaatgtaccatgctaaggccaaaggtcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatactggacatatccatgatgactggcttcgttccagacacagatgacctcaagcagctggcaaacggcgttgacagatacatctccaagtatgagctggacaaagccttctccgataggaacaccctcatcatctacctggacaaggtctcacactctgaggatgactgtatagctttcaaagttcaccaatattttaatgtagagcttatccagcctggtgcagtcaaggtctacgcctattacaacctggcggaaagctgtacccggttctaccacccagaaaaggaggatggaaagctgaacaagctctgtcgtgatgagctgtgccgctgtgctgaggagaattgcttcatacaaaagttggatgacaaagtcaccctggaagaacggctggacaaggcctgtgagccaggagtggactatgtgtacaagacccgactggtcaaggcccagctgtccaatgactttgacgagtacatcatggccattgagcagatcatcaagtcaggctcggatgaggtgcaggttggacaacagcgcacgttcatcagccccatcaagtgcagggaagccctgaagctggaggagaggaaacactacctcatgtggggtctctcctccgatttctggggagagaaacccaatctcagctacatcatcgggaaggacacctgggtggagcactggcccgaggaggacgaatgccaagatgaagagaaccagaaacaatgccaggacctcggcaccttcactgagaacatggttgtctttgggtgccccaactgaccacacccccattcccccactcccaataaagcttcagttatatttca

SEQ ID NO: 8 - DNA, 5126 bp, Macaca fascicularis
tgaaatataactgaagctttattgggagtgggggaatgggggtgtggtcagttggggcacccaaagacaaccatgttctcagtgaaggtgccgaggtcctggcattgtttctggttctcttcatcttggcattcgtcctcctcgggccagtgctccacccaggtgtccttcccgatgatgtagctgagattgggtttctctccccagaaatcggaggagagaccccacatgaggtagtgtttcctctcctccagcttcagggcttccctgcacttgatggggctgatgaacgtgcgctgttgtccaacctgcacctcatccgagcctgacttgatgatctgctcaatggccatgatgtactcgtcaaagtcattggacagctgggccttgaccagtcgggtcttgtacacatagtccactcctggctcacaggccttgtccagccgttcttccagggtgactttgtcatccaacttttgtatgaagcaattctcctcagcacagcggcacagctcatcacgacagagcttgttcagctttccatcctccttttctgggtggtagaaccgggtacagctttccgccaggttgtaataggcgtagaccttgactgcaccaggctggataagctctacattaaaatattggtgaactttgaaagctatacagtcatcctcagagtgtgagaccttgtccaggtagatgatgagggtgttcctatcggagaaggctttgtccagctcatacttggagatgtatctgtcaacgccgtttgccagctgcttgaggtcatctgtgtctggaacgaagccagtcatcatggatatgtccagtatagacatagtggcatcctggtctccccggtacctggtacagatctcaaggatcatagtgttcttggcatcctgaggcctcttttctgtttccggtgctggttttatggtgaccttgaggtcgaatttattacaggtgagttgacctttggccttagcatggtacattgtcactaccgacaaggtgccttggccttttccttcagctgtgactgtgaaaccctcattttccttggtctcttctgatcgcaggaggctggcagattcccagtggatacggtggatgatcttggagctgcgactgggcagttggagggacacatccaggttcagttccttgtgatcagggacatccttttggtattgagccaaggcttggaacaccatgaaggtggcctgggtagagccatagccaccaccgtagtatctctgttcattgagccaacgcacgacgggaggcacaaagtcaaagtcttttagctgcagtagggccaagagggcataggatgtggcctccacattgtagagctgctgaccaggctcctcccagcggttcttatctttggctgtggtcagaaatttgttgagaagaggtcccttcagcctgcccatctgggccagggcataggcagcgatggccacagtgtaggatctctgtaggttcatgtagttggcttcaaggaagtctcctgctttagtgatgctgccgggcaggctgttgacctgctcctcgcaaatctctttagcctcttgcagcgagatgagaacaaaggccgtgagggccatgtctttctcgttggtgttccggaatccaccagtcatttcttgatgtatcacgggcgcatcctcctggaagaccccgtcgggcttctgcttctccaggatcagccatttaacagccccgcagaggacctgggagtcgatggcaatgaggttgacagccagagagaagaccttgaccacgtaggcggtcagccaggtgctgggtgcccggttcaggaaggccgcaaaggcagagctgggttgtctgaaggccagctgctgggtgtaccccttcttgatgagctccaaggccccctgccgcttctccgggccgaacttctcccactgttccgtttcatccaggtaatgcacagcgatgactgtgggcgtcatggtgatcatgttctgttctccgcagcccgagggggtcacgatgaggtgcttcagccgttccgcatcgatggcatcctctgtcatctgggccaccggggtcccttgcaggagaattctggtctcagactcggtgtccgggacttggtcactgaggtctgcaggtgggacgtcctctctctgcactccttcctggcccaggcgttctggatccagcgtgcgaacagccacagttttgttcattctgattccttccggcacgaccttcagggacttcctgacaccgtcactgatgaaaaaatggtagacggcagccttgacttccacttcctgctggccggtctttaggggcacgatgacataaggaacggacagcgaggacttgggggggatggttacggtctgctggtgacgcctcttggcggtggccaggctgcagaaggctggattgtggagtagttccaccctcaccttgagctcttggttctgccggtaattgtagagaacagctcggatttccacctgctcgtttcgaacaacagagtagggtagccgcaggtcgatgaagaagtcctgcattactgtgacctcgaaggggtctgccacacagatccctttcttgtctgacaagctcacggccagaatctcccacgtggtgatggagtctttcaaaaatatattcatgagcttcgtggagattccgtttttcggtgcctctttcaactcttcaatcttccacagccaactctctgggaactcacttcgggaaacgatgttctcttctgcgatgatgtcctcatccaggttactcctggccaggcccaggtgactggcccgcgcgtgctgccgccgcagctcggtgatgtagttgcagcagtccaggaaggccttcttgcacgcctcgtccagggtgatgtaacgggtccggcgctggcatgagaacctcatggggttctcccgcataccgtgctcgcagcacttgcgcagctccttggggtactgaccaactttgtccattctcttctccgcgagctgcacggaacggcgtcggcgggcggctggctgtgggcactgaagttctgccctctgggccgtctgctggccactgctgctcgcaaaggtcaggcctgcatccgagaagacaccagcgtaatccttcccactgcctggggtgcagccgatgtctgccttctccaccacgtcccagatcttactctgcgtcagcttgttcttcttattcagcacaaacacgcccttgtccacagccaccagtcccacccgggccccgtggtcaccctctatcttcagggtcatctgctgcccgggtaaaggctgcctgtcttctgactggccgctttttaccaccagcgagcccacgcaagagtccttgacgtccacccacacggagtcggccaccacttccctctggccgttggcgccgatcagcgtgtagtaggccaccaggcggaaggaagggatgaagtcggtggtgatggacaggggcagcaccaccaggtcctggccaggctctcgcacctggcgtcccaccttcaacagcttgcctttgttcataatcaggtaggtgtagtagcggatcttggcctcctgggtgcggtccattcgcaggaggaagttgacgttgagggtctccccaggtctgagctctgcacgtggcactgagagatgcaggtaattgttggagttgcccacggtgctgtagggctgagcctccatggtcctggtagcctgctccgcctccgagagctcccgcttcttcgtgcgcaccgtgatgctcaagggcttctggctggggtgtgtgttgatgctgagtttggccacgccgtctccctgggttagagactgcacagcgtcctcgccctggactgccacggggactcggtaggctggagagccatcggggttcgtcacgaacaccatgaggtcaaagggcattcctggtttgaagtacttgggcgtcttggtgaagtggatctggtagggagaggtcacgatggggatcccgctgcgctccgcctgcaccatgtcactgcctgagtgcaggataacggtgacagacacatacaaggacttccccactaggtcttccggtcggggattctgcaccccgtccagcagtaccttccggctcagcacggcgtctcctgagccatcctcaatctggatgcgcttgagggattcaggcagggaaatcctctgctcgccatcctggatcccgaagatgacaaaggcagttccctccactttctttccatagaggaacctggcggtgatggtgacctccaggcccttctggttatagatgtagtagaatttctctgtaggctccactatgacctcgaaactgggcagcacgtactccttcacctcaaactcagtggagaagacctgttgcggcgaattttcatagtaggctcggatcttccactggcccatgttgacgagttccggaatgtcccaagacaagggcaagatgccaaattggttctgagaagacaaggagtcctgcttgaccgggatgccgtccgggttctcaatgttgaccacgaccgtccggcccacgggtagcagcttgtggttgacggtgaagatccgacagagaactgtggagccaggggtgtagatggtcttgtctgtctggatgaagaggtacccgctctgaaggctgaccagtaccaccttctccaccacttgggccccgaaggtggcctgcacagtcacgaacttgttgtgccccttttctgacttgaactccttgttggctgggatcctgatggtgacgctgcccatgtggctggtggcaggggtcagcacggtcttctcactggacagcaccagttttttgcctgggaagtcgtggacagtgacagtgaccggaacatccccattcgcgtcatgggcctccagcaccacggtctcctcactctccagccgcaagacgtttggggtgatcatagagtacatgggagtccccagagccagggggaggtggattagtagcaggagcagcaggctgggacctgaggtgagtcccatggtgctgggacagtgcagggtcagagggacagagggacagagggagaggatggggaggagtgagcagtgactgctggagttggcttt

SEQ ID NO: 9 - RNA, 19 nt, Artificial Sequence
  source: /note="Description of Artificial Sequence: Synthetic oligonucleotide"
ucacuccuccccauccucu

SEQ ID NO: 10 - RNA, 19 nt, Artificial Sequence
  source: /note="Description of Artificial Sequence: Synthetic oligonucleotide"
ucugucccucugucccucu

SEQ ID NO: 11 - RNA, 19 nt, Artificial Sequence
  source: /note="Description of Artificial Sequence: Synthetic oligonucleotide"
cagcaccaugggacccaca

SEQ ID NO: 12 - RNA, 19 nt, Artificial Sequence
  source: /note="Description of Artificial Sequence: Synthetic oligonucleotide"
ccucaggucccagccugcu

SEQ ID NO: 13 - RNA, 19 nt, Artificial Sequence
  source: /note="Description of Artificial Sequence: Synthetic oligonucleotide"
ccagccugcugcuccugcu

SEQ ID NO: 14 - RNA, 19 nt, Artificial Sequence
  source: /note="Description of Artificial Sequence: Synthetic oligonucleotide"
uacuaacccaccucccccu

SEQ ID NO: 15 - RNA, 19 nt, Artificial Sequence
  source: /note="Description of Artificial Sequence: Synthetic oligonucleotide"
uacucuaucaucaccccca

SEQ ID NO: 16 - RNA, 19 nt, Artificial Sequence
  source: /note="Description of Artificial Sequence: Synthetic oligonucleotide"
caacaucuugcggcuggaa

SEQ ID NO: 17 - RNA, 19 nt, Artificial Sequence
  source: /note="Description of Artificial Sequence: Synthetic oligonucleotide"
agagcgaggagaccauggu

SEQ ID NO: 18 - RNA, 19 nt, Artificial Sequence
  source: /note="Description of Artificial Sequence: Synthetic oligonucleotide"
uuccagucacuguuacugu

SEQ ID NO: 19 - RNA, 19 nt, Artificial Sequence
  source: /note="Description of Artificial Sequence: Synthetic oligonucleotide"
uucccaggcaaaaaacuaa

SEQ ID NO: 20 - RNA, 19 nt, Artificial Sequence
  source: /note="Description of Artificial Sequence: Synthetic oligonucleotide"
agugcuguccagugagaaa

SEQ ID NO: 21 - RNA, 19 nt, Artificial Sequence
  source: /note="Description of Artificial Sequence: Synthetic oligonucleotide"
agacugugcugaccccuga

SEQ ID NO: 22 - RNA, 19 nt, Artificial Sequence
  source: /note="Description of Artificial Sequence: Synthetic oligonucleotide"
cagggaguucaagucagaa

SEQ ID NO: 23 - RNA, 19 nt, Artificial Sequence
  source: /note="Description of Artificial Sequence: Synthetic oligonucleotide"
uucaagucagaaaagggga

SEQ ID NO: 24 - RNA, 19 nt, Artificial Sequence
  source: /note="Description of Artificial Sequence: Synthetic oligonucleotide"
uucgugaccgugcaggcca

SEQ ID NO: 25 - RNA, 19 nt, Artificial Sequence
  source: /note="Description of Artificial Sequence: Synthetic oligonucleotide"
caggccaccuucgggacca

SEQ ID NO: 26 - RNA, 19 nt, Artificial Sequence
  source: /note="Description of Artificial Sequence: Synthetic oligonucleotide"
caagugguggagaagguga

SEQ ID NO: 27 - RNA, 19 nt, Artificial Sequence
  source: /note="Description of Artificial Sequence: Synthetic oligonucleotide"
gugcuggucagccugcaga

SEQ ID NO: 28 - RNA, 19 nt, Artificial Sequence
  source: /note="Description of Artificial Sequence: Synthetic oligonucleotide"
agcggguaccucuucauca

SEQ ID NO: 29 - RNA, 19 nt, Artificial Sequence
  source: /note="Description of Artificial Sequence: Synthetic oligonucleotide"
cagacagacaagaccaucu

SEQ ID NO: 30 - RNA, 19 nt, Artificial Sequence
  source: /note="Description of Artificial Sequence: Synthetic oligonucleotide"
cuacaccccuggcuccaca

SEQ ID NO: 31 - RNA, 19 nt, Artificial Sequence
  source: /note="Description of Artificial Sequence: Synthetic oligonucleotide"
acaguucucuaucggaucu

SEQ ID NO: 32 - RNA, 19 nt, Artificial Sequence
  source: /note="Description of Artificial Sequence: Synthetic oligonucleotide"
uucaccgucaaccacaaga

SEQ ID NO: 33 - RNA, 19 nt, Artificial Sequence
  source: /note="Description of Artificial Sequence: Synthetic oligonucleotide"
ggacggucauggucaacau

SEQ ID NO: 34 - RNA, 19 nt, Artificial Sequence
  source: /note="Description of Artificial Sequence: Synthetic oligonucleotide"
uugagaacccggaaggcau

SEQ ID NO: 35 - RNA, 19 nt, Artificial Sequence
  source: /note="Description of Artificial Sequence: Synthetic oligonucleotide"
aucccggucaagcaggacu

SEQ ID NO: 36 - RNA, 19 nt, Artificial Sequence
  source: /note="Description of Artificial Sequence: Synthetic oligonucleotide"
cuccuugucuucucagaaa

SEQ ID NO: 37 - RNA, 19 nt, Artificial Sequence
  source: /note="Description of Artificial Sequence: Synthetic oligonucleotide"
uugucuucucagaaccaga

SEQ ID NO: 38 - RNA, 19 nt, Artificial Sequence
  source: /note="Description of Artificial Sequence: Synthetic oligonucleotide"
gcuuggcgucuugcccuua

SEQ ID NO: 39 - RNA, 19 nt, Artificial Sequence
  source: /note="Description of Artificial Sequence: Synthetic oligonucleotide"
ugcccuugucuugggacau

SEQ ID NO: 40 - RNA, 19 nt, Artificial Sequence
  source: /note="Description of Artificial Sequence: Synthetic oligonucleotide"
augggccaguggaagauca

SEQ ID NO: 41 - RNA, 19 nt, Artificial Sequence
  source: /note="Description of Artificial Sequence: Synthetic oligonucleotide"
gccaguggaagauccgaga

SEQ ID NO: 42 - RNA, 19 nt, Artificial Sequence
  source: /note="Description of Artificial Sequence: Synthetic oligonucleotide"
ccuacuaugaaaacucaca

SEQ ID NO: 43 - RNA, 19 nt, Artificial Sequence
  source: /note="Description of Artificial Sequence: Synthetic oligonucleotide"
cacugaguuugaggugaaa

SEQ ID NO: 44 - RNA, 19 nt, Artificial Sequence
  source: /note="Description of Artificial Sequence: Synthetic oligonucleotide"
uuugaggugaaggaguaca

SEQ ID NO: 45 - RNA, 19 nt, Artificial Sequence
  source: /note="Description of Artificial Sequence: Synthetic oligonucleotide"
cgugcugcccaguuucgaa

SEQ ID NO: 46 - RNA, 19 nt, Artificial Sequence
  source: /note="Description of Artificial Sequence: Synthetic oligonucleotide"
aggucauaguggagccuaa

SEQ ID NO: 47 - RNA, 19 nt, Artificial Sequence
  source: /note="Description of Artificial Sequence: Synthetic oligonucleotide"
cagagaaauucuacuacau

SEQ ID NO: 48 - RNA, 19 nt, Artificial Sequence
  source: /note="Description of Artificial Sequence: Synthetic oligonucleotide"
ucuauaacgagaagggccu

SEQ ID NO: 49 - RNA, 19 nt, Artificial Sequence
  source: /note="Description of Artificial Sequence: Synthetic oligonucleotide"
cuggaggucaccaucacca

SEQ ID NO: 50 - RNA, 19 nt, Artificial Sequence
  source: /note="Description of Artificial Sequence: Synthetic oligonucleotide"
gccagguuccucuacggga

SEQ ID NO: 51 - RNA, 19 nt, Artificial Sequence
  source: /note="Description of Artificial Sequence: Synthetic oligonucleotide"
aagaaaguggagggaacua

SEQ ID NO: 52 - RNA, 19 nt, Artificial Sequence
  source: /note="Description of Artificial Sequence: Synthetic oligonucleotide"
ggaacugccuuugucaucu

SEQ ID NO: 53 - RNA, 19 nt, Artificial Sequence
  source: /note="Description of Artificial Sequence: Synthetic oligonucleotide"
uucgggauccaggauggca

SEQ ID NO: 54 - RNA, 19 nt, Artificial Sequence
  source: /note="Description of Artificial Sequence: Synthetic oligonucleotide"
cgaacagaggauuucccua

SEQ ID NO: 55 - RNA, 19 nt, Artificial Sequence
  source: /note="Description of Artificial Sequence: Synthetic oligonucleotide"
uuucccugccugaaucccu

SEQ ID NO: 56 - RNA, 19 nt, Artificial Sequence
  source: /note="Description of Artificial Sequence: Synthetic oligonucleotide"
cucaagcgcauuccgauua

SEQ ID NO: 57 - RNA, 19 nt, Artificial Sequence
  source: /note="Description of Artificial Sequence: Synthetic oligonucleotide"
ugaggauggcucgggggaa

SEQ ID NO: 58 - RNA, 19 nt, Artificial Sequence
  source: /note="Description of Artificial Sequence: Synthetic oligonucleotide"
agguugugcugagccggaa

SEQ ID NO: 59 - RNA, 19 nt, Artificial Sequence
  source: /note="Description of Artificial Sequence: Synthetic oligonucleotide"
ugcugagccggaagguacu

SEQ ID NO: 60 - RNA, 19 nt, Artificial Sequence
  source: /note="Description of Artificial Sequence: Synthetic oligonucleotide"
gguacugcuggacggggua

SEQ ID NO: 61 - RNA, 19 nt, Artificial Sequence
  source: /note="Description of Artificial Sequence: Synthetic oligonucleotide"
gcagaacccccgagcagaa

SEQ ID NO: 62 - RNA, 19 nt, Artificial Sequence
  source: /note="Description of Artificial Sequence: Synthetic oligonucleotide"
uacgugucugccaccguca

SEQ ID NO: 63 - RNA, 19 nt, Artificial Sequence
  source: /note="Description of Artificial Sequence: Synthetic oligonucleotide"
uugcacucaggcagugaca

SEQ ID NO: 64 - RNA, 19 nt, Artificial Sequence
  source: /note="Description of Artificial Sequence: Synthetic oligonucleotide"
aggcagagcgcagcgggau

SEQ ID NO: 65 - RNA, 19 nt, Artificial Sequence
  source: /note="Description of Artificial Sequence: Synthetic oligonucleotide"
uucaccaagacacccaagu

SEQ ID NO: 66 - RNA, 19 nt, Artificial Sequence
  source: /note="Description of Artificial Sequence: Synthetic oligonucleotide"
accaagacacccaaguacu

SEQ ID NO: 67 - RNA, 19 nt, Artificial Sequence
  source: /note="Description of Artificial Sequence: Synthetic oligonucleotide"
uucaaaccaggaaugcccu

SEQ ID NO: 68 - RNA, 19 nt, Artificial Sequence
  source: /note="Description of Artificial Sequence: Synthetic oligonucleotide"
ucgugacgaacccugauga

SEQ ID NO: 69 - RNA, 19 nt, Artificial Sequence
  source: /note="Description of Artificial Sequence: Synthetic oligonucleotide"
uccagggcgaggacacugu

SEQ ID NO: 70 - RNA, 19 nt, Artificial Sequence
  source: /note="Description of Artificial Sequence: Synthetic oligonucleotide"
gaggacacugugcagucua

SEQ ID NO: 71 - RNA, 19 nt, Artificial Sequence
  source: /note="Description of Artificial Sequence: Synthetic oligonucleotide"
cuaacccagggagauggca

SEQ ID NO: 72 - RNA, 19 nt, Artificial Sequence
  source: /note="Description of Artificial Sequence: Synthetic oligonucleotide"
cguggccaaacucagcaua

SEQ ID NO: 73 - RNA, 19 nt, Artificial Sequence
  source: /note="Description of Artificial Sequence: Synthetic oligonucleotide"
ucaacacacaccccagcca

SEQ ID NO: 74 - RNA, 19 nt, Artificial Sequence
  source: /note="Description of Artificial Sequence: Synthetic oligonucleotide"
cagaagcccuugagcauca

SEQ ID NO: 75 - RNA, 19 nt, Artificial Sequence
  source: /note="Description of Artificial Sequence: Synthetic oligonucleotide"
uugagcaucacggugcgca

SEQ ID NO: 76 - RNA, 19 nt, Artificial Sequence
  source: /note="Description of Artificial Sequence: Synthetic oligonucleotide"
gagcucucggaggcagaga

SEQ ID NO: 77 - RNA, 19 nt, Artificial Sequence
  source: /note="Description of Artificial Sequence: Synthetic oligonucleotide"
caggcuaccaggaccauga

SEQ ID NO: 78 - RNA, 19 nt, Artificial Sequence
  source: /note="Description of Artificial Sequence: Synthetic oligonucleotide"
gcaggcucugcccuacaga

SEQ ID NO: 79 - RNA, 19 nt, Artificial Sequence
  source: /note="Description of Artificial Sequence: Synthetic oligonucleotide"
uacagcaccgugggcaacu

SEQ ID NO: 80 - RNA, 19 nt, Artificial Sequence
  source: /note="Description of Artificial Sequence: Synthetic oligonucleotide"
cuccaacaauuaccugcau

SEQ ID NO: 81 - RNA, 19 nt, Artificial Sequence
  source: /note="Description of Artificial Sequence: Synthetic oligonucleotide"
cagugcuacguacagagcu

SEQ ID NO: 82 - RNA, 19 nt, Artificial Sequence
  source: /note="Description of Artificial Sequence: Synthetic oligonucleotide"
ucagacccggggagacccu

SEQ ID NO: 83 - RNA, 19 nt, Artificial Sequence
  source: /note="Description of Artificial Sequence: Synthetic oligonucleotide"
gcgcccacgaggccaagau

SEQ ID NO: 84 - RNA, 19 nt, Artificial Sequence
  source: /note="Description of Artificial Sequence: Synthetic oligonucleotide"
uccgcuacuacaccuaccu

SEQ ID NO: 85 - RNA, 19 nt, Artificial Sequence
  source: /note="Description of Artificial Sequence: Synthetic oligonucleotide"
cugaucaugaacaagggca

SEQ ID NO: 86 - RNA, 19 nt, Artificial Sequence
  source: /note="Description of Artificial Sequence: Synthetic oligonucleotide"
caggcuguugaaggcggga

SEQ ID NO: 87 - RNA, 19 nt, Artificial Sequence
  source: /note="Description of Artificial Sequence: Synthetic oligonucleotide"
gacgccaggugcgagagca

SEQ ID NO: 88 - RNA, 19 nt, Artificial Sequence
  source: /note="Description of Artificial Sequence: Synthetic oligonucleotide"
cccggccaggaccugguga

SEQ ID NO: 89 - RNA, 19 nt, Artificial Sequence
  source: /note="Description of Artificial Sequence: Synthetic oligonucleotide"
uuccgccugguggcguacu

SEQ ID NO: 90 - RNA, 19 nt, Artificial Sequence
  source: /note="Description of Artificial Sequence: Synthetic oligonucleotide"
cuacacgcugaucggugca

SEQ ID NO: 91 - RNA, 19 nt, Artificial Sequence
  source: /note="Description of Artificial Sequence: Synthetic oligonucleotide"
uggguggacgucaaggacu

SEQ ID NO: 92 - RNA, 19 nt, Artificial Sequence
  source: /note="Description of Artificial Sequence: Synthetic oligonucleotide"
ccugcgugggcucgcuggu

SEQ ID NO: 93 - RNA, 19 nt, Artificial Sequence
  source: /note="Description of Artificial Sequence: Synthetic oligonucleotide"
ugguaaaaagcggccagua

SEQ ID NO: 94 - RNA, 19 nt, Artificial Sequence
  source: /note="Description of Artificial Sequence: Synthetic oligonucleotide"
cagaagaccggcagccugu

SEQ ID NO: 95 - RNA, 19 nt, Artificial Sequence
  source: /note="Description of Artificial Sequence: Synthetic oligonucleotide"
ccugggcagcagaugacca

SEQ ID NO: 96 - RNA, 19 nt, Artificial Sequence
  source: /note="Description of Artificial Sequence: Synthetic oligonucleotide"
cugaagauagagggugaca

SEQ ID NO: 97 - RNA, 19 nt, Artificial Sequence
  source: /note="Description of Artificial Sequence: Synthetic oligonucleotide"
ccacggggcccggguggua

SEQ ID NO: 98 - RNA, 19 nt, Artificial Sequence
  source: /note="Description of Artificial Sequence: Synthetic oligonucleotide"
acugguggccguggacaaa

SEQ ID NO: 99 - RNA, 19 nt, Artificial Sequence
  source: /note="Description of Artificial Sequence: Synthetic oligonucleotide"
uaagaagaacaaacugaca

SEQ ID NO: 100 - RNA, 19 nt, Artificial Sequence
  source: /note="Description of Artificial Sequence: Synthetic oligonucleotide"
cgcagaguaagaucuggga

SEQ ID NO: 101 - RNA, 19 nt, Artificial Sequence
  source: /note="Description of Artificial Sequence: Synthetic oligonucleotide"
gacgugguggagaaggcaa

SEQ ID NO: 102 - RNA, 19 nt, Artificial Sequence
  source: /note="Description of Artificial Sequence: Synthetic oligonucleotide"
accccgggcagugggaaga

SEQ ID NO: 103 - RNA, 19 nt, Artificial Sequence
  source: /note="Description of Artificial Sequence: Synthetic oligonucleotide"
gauuacgccggugucuucu

SEQ ID NO: 104 - RNA, 19 nt, Artificial Sequence
  source: /note="Description of Artificial Sequence: Synthetic oligonucleotide"
uccgacgcagggcugaccu

SEQ ID NO: 105 - RNA, 19 nt, Artificial Sequence
  source: /note="Description of Artificial Sequence: Synthetic oligonucleotide"
uucacgagcagcaguggca

SEQ ID NO: 106 - RNA, 19 nt, Artificial Sequence
  source: /note="Description of Artificial Sequence: Synthetic oligonucleotide"
ccagcagaccgcccagaga

SEQ ID NO: 107 - RNA, 19 nt, Artificial Sequence
  source: /note="Description of Artificial Sequence: Synthetic oligonucleotide"
ccgcccagagggcagaacu

SEQ ID NO: 108 - RNA, 19 nt, Artificial Sequence
  source: /note="Description of Artificial Sequence: Synthetic oligonucleotide"
uucagugcccgcagccaga

SEQ ID NO: 109 - RNA, 19 nt, Artificial Sequence
  source: /note="Description of Artificial Sequence: Synthetic oligonucleotide"
gccgcccgccgacgccguu

SEQ ID NO: 110 - RNA, 19 nt, Artificial Sequence
  source: /note="Description of Artificial Sequence: Synthetic oligonucleotide"
acggagaagcgaauggaca

SEQ ID NO: 111 - RNA, 19 nt, Artificial Sequence
  source: /note="Description of Artificial Sequence: Synthetic oligonucleotide"
aaagucggcaaguacccca

SEQ ID NO: 112 - RNA, 19 nt, Artificial Sequence
  source: /note="Description of Artificial Sequence: Synthetic oligonucleotide"
caaggagcugcgcaaguga

SEQ ID NO: 113 - RNA, 19 nt, Artificial Sequence
  source: /note="Description of Artificial Sequence: Synthetic oligonucleotide"
gcugcgaggacggcaugca

SEQ ID NO: 114 - RNA, 19 nt, Artificial Sequence
  source: /note="Description of Artificial Sequence: Synthetic oligonucleotide"
ccaugagguucucgugcca

SEQ ID NO: 115 - RNA, 19 nt, Artificial Sequence
  source: /note="Description of Artificial Sequence: Synthetic oligonucleotide"
uucucgugccagcgccgga

SEQ ID NO: 116 - RNA, 19 nt, Artificial Sequence
  source: /note="Description of Artificial Sequence: Synthetic oligonucleotide"
cguuucaucucccugggca

SEQ ID NO: 117 - RNA, 19 nt, Artificial Sequence
  source: /note="Description of Artificial Sequence: Synthetic oligonucleotide"
gaggcgugcaagaaggucu

SEQ ID NO: 118 - RNA, 19 nt, Artificial Sequence
  source: /note="Description of Artificial Sequence: Synthetic oligonucleotide"
uuccuggacugcugcaacu

SEQ ID NO: 119 - RNA, 19 nt, Artificial Sequence
  source: /note="Description of Artificial Sequence: Synthetic oligonucleotide"
cuacaucacagagcugcga

SEQ ID NO: 120 - RNA, 19 nt, Artificial Sequence
  source: /note="Description of Artificial Sequence: Synthetic oligonucleotide"
acgcgcgggccagccaccu

SEQ ID NO: 121 - RNA, 19 nt, Artificial Sequence
  source: /note="Description of Artificial Sequence: Synthetic oligonucleotide"
ugggccuggccaggaguaa

SEQ ID NO: 122 - RNA, 19 nt, Artificial Sequence
  source: /note="Description of Artificial Sequence: Synthetic oligonucleotide"
accuggaugaggacaucau

SEQ ID NO: 123 - RNA, 19 nt, Artificial Sequence
  source: /note="Description of Artificial Sequence: Synthetic oligonucleotide"
uugcagaagagaacaucgu

SEQ ID NO: 124 - RNA, 19 nt, Artificial Sequence
  source: /note="Description of Artificial Sequence: Synthetic oligonucleotide"
guuucccgaagugaguuca

SEQ ID NO: 125 - RNA, 19 nt, Artificial Sequence
  source: /note="Description of Artificial Sequence: Synthetic oligonucleotide"
uucccagagagcuggcugu

SEQ ID NO: 126 - RNA, 19 nt, Artificial Sequence
  source: /note="Description of Artificial Sequence: Synthetic oligonucleotide"
guggaacguugaggacuua

SEQ ID NO: 127 - RNA, 19 nt, Artificial Sequence
  source: /note="Description of Artificial Sequence: Synthetic oligonucleotide"
uugaggacuugaaagagca

SEQ ID NO: 128 - RNA, 19 nt, Artificial Sequence
  source: /note="Description of Artificial Sequence: Synthetic oligonucleotide"
aggacuugaaagagccaca

SEQ ID NO: 129 - RNA, 19 nt, Artificial Sequence
  source: /note="Description of Artificial Sequence: Synthetic oligonucleotide"
cgaaaaauggaaucucuaa

SEQ ID NO: 130 - RNA, 19 nt, Artificial Sequence
  source: /note="Description of Artificial Sequence: Synthetic oligonucleotide"
cucuacgaagcucaugaau

SEQ ID NO: 131 - RNA, 19 nt, Artificial Sequence
  source: /note="Description of Artificial Sequence: Synthetic oligonucleotide"
uauauuuuugaaagacuca

SEQ ID NO: 132 - RNA, 19 nt, Artificial Sequence
  source: /note="Description of Artificial Sequence: Synthetic oligonucleotide"
ccaucaccacgugggagau

SEQ ID NO: 133 - RNA, 19 nt, Artificial Sequence
  source: /note="Description of Artificial Sequence: Synthetic oligonucleotide"
auucuggcugugagcaugu

SEQ ID NO: 134 - RNA, 19 nt, Artificial Sequence
  source: /note="Description of Artificial Sequence: Synthetic oligonucleotide"
ucggacaagaaagggaucu

SEQ ID NO: 135 - RNA, 19 nt, Artificial Sequence
  source: /note="Description of Artificial Sequence: Synthetic oligonucleotide"
gcagaccccuucgagguca

SEQ ID NO: 136 - RNA, 19 nt, Artificial Sequence
  source: /note="Description of Artificial Sequence: Synthetic oligonucleotide"
uucaucgaccugcggcuaa

SEQ ID NO: 137 - RNA, 19 nt, Artificial Sequence
  source: /note="Description of Artificial Sequence: Synthetic oligonucleotide"
acccuacucuguuguucga

SEQ ID NO: 138 - RNA, 19 nt, Artificial Sequence
  source: /note="Description of Artificial Sequence: Synthetic oligonucleotide"
cuguuguucgaaacgagca

SEQ ID NO: 139 - RNA, 19 nt, Artificial Sequence
  source: /note="Description of Artificial Sequence: Synthetic oligonucleotide"
cagguggaaauccgagcca

SEQ ID NO: 140 - RNA, 19 nt, Artificial Sequence
  source: /note="Description of Artificial Sequence: Synthetic oligonucleotide"
cguucucuacaauuaccga

SEQ ID NO: 141 - RNA, 19 nt, Artificial Sequence
  source: /note="Description of Artificial Sequence: Synthetic oligonucleotide"
aagagcucaaggugagggu

SEQ ID NO: 142 - RNA, 19 nt, Artificial Sequence
  source: /note="Description of Artificial Sequence: Synthetic oligonucleotide"
guggaacuacuccacaaua

SEQ ID NO: 143 - RNA, 19 nt, Artificial Sequence
  source: /note="Description of Artificial Sequence: Synthetic oligonucleotide"
uacuccacaauccagccuu

SEQ ID NO: 144 - RNA, 19 nt, Artificial Sequence
  source: /note="Description of Artificial Sequence: Synthetic oligonucleotide"
uucugcagccuggccacca

SEQ ID NO: 145 - RNA, 19 nt, Artificial Sequence
  source: /note="Description of Artificial Sequence: Synthetic oligonucleotide"
caccaagaggcgucaccaa

SEQ ID NO: 146 - RNA, 19 nt, Artificial Sequence
  source: /note="Description of Artificial Sequence: Synthetic oligonucleotide"
agcagaccguaaccaucca

SEQ ID NO: 147 - RNA, 19 nt, Artificial Sequence
  source: /note="Description of Artificial Sequence: Synthetic oligonucleotide"
uccucguuguccguuccau

SEQ ID NO: 148 - RNA, 19 nt, Artificial Sequence
  source: /note="Description of Artificial Sequence: Synthetic oligonucleotide"
uaugucaucgugccgcuaa

SEQ ID NO: 149 - RNA, 19 nt, Artificial Sequence
  source: /note="Description of Artificial Sequence: Synthetic oligonucleotide"
agaccggccugcaggaagu

SEQ ID NO: 150 - RNA, 19 nt, Artificial Sequence
  source: /note="Description of Artificial Sequence: Synthetic oligonucleotide"
guggaagucaaggcugcua

SEQ ID NO: 151 - RNA, 19 nt, Artificial Sequence
  source: /note="Description of Artificial Sequence: Synthetic oligonucleotide"
uucaucagugacgguguca

SEQ ID NO: 152 - RNA, 19 nt, Artificial Sequence
  source: /note="Description of Artificial Sequence: Synthetic oligonucleotide"
caggaagucccugaaggua

SEQ ID NO: 153 - RNA, 19 nt, Artificial Sequence
  source: /note="Description of Artificial Sequence: Synthetic oligonucleotide"
aaucagaaugaacaaaacu

SEQ ID NO: 154 - RNA, 19 nt, Artificial Sequence
  source: /note="Description of Artificial Sequence: Synthetic oligonucleotide"
cuguggcuguucgcacccu

SEQ ID NO: 155 - RNA, 19 nt, Artificial Sequence
  source: /note="Description of Artificial Sequence: Synthetic oligonucleotide"
cuggauccagaacgccuga

SEQ ID NO: 156 - RNA, 19 nt, Artificial Sequence
  source: /note="Description of Artificial Sequence: Synthetic oligonucleotide"
aaggagugcagaaagagga

SEQ ID NO: 157 - RNA, 19 nt, Artificial Sequence
  source: /note="Description of Artificial Sequence: Synthetic oligonucleotide"
gugaccaagucccggacaa

SEQ ID NO: 158 - RNA, 19 nt, Artificial Sequence
  source: /note="Description of Artificial Sequence: Synthetic oligonucleotide"
ccgagucugagaccagaau

SEQ ID NO: 159 - RNA, 19 nt, Artificial Sequence
  source: /note="Description of Artificial Sequence: Synthetic oligonucleotide"
uucuccugcaagggaccca

SEQ ID NO: 160 - RNA, 19 nt, Artificial Sequence
  source: /note="Description of Artificial Sequence: Synthetic oligonucleotide"
ccaguggcccagaugacaa

SEQ ID NO: 161 - RNA, 19 nt, Artificial Sequence
  source: /note="Description of Artificial Sequence: Synthetic oligonucleotide"
cgucgacgcggaacggcua

SEQ ID NO: 162 - RNA, 19 nt, Artificial Sequence
  source: /note="Description of Artificial Sequence: Synthetic oligonucleotide"
cggggaacagaacaugaua

SEQ ID NO: 163 - RNA, 19 nt, Artificial Sequence
  source: /note="Description of Artificial Sequence: Synthetic oligonucleotide"
ucggcaugacgcccacggu

SEQ ID NO: 164 - RNA, 19 nt, Artificial Sequence
  source: /note="Description of Artificial Sequence: Synthetic oligonucleotide"
uaccuggaugaaacggaga

SEQ ID NO: 165 - RNA, 19 nt, Artificial Sequence
  source: /note="Description of Artificial Sequence: Synthetic oligonucleotide"
uggaugaaacggagcagua

SEQ ID NO: 166 - RNA, 19 nt, Artificial Sequence
  source: /note="Description of Artificial Sequence: Synthetic oligonucleotide"
gggagaaguucggccuaga

SEQ ID NO: 167 - RNA, 19 nt, Artificial Sequence
  source: /note="Description of Artificial Sequence: Synthetic oligonucleotide"
agaagcggcagggggccuu

SEQ ID NO: 168 - RNA, 19 nt, Artificial Sequence
  source: /note="Description of Artificial Sequence: Synthetic oligonucleotide"
uuggagcucaucaagaaga

SEQ ID NO: 169 - RNA, 19 nt, Artificial Sequence
  source: /note="Description of Artificial Sequence: Synthetic oligonucleotide"
gagcucaucaagaaggggu

SEQ ID NO: 170 - RNA, 19 nt, Artificial Sequence
  source: /note="Description of Artificial Sequence: Synthetic oligonucleotide"
uacacccagcagcuggccu

SEQ ID NO: 171 - RNA, 19 nt, Artificial Sequence
  source: /note="Description of Artificial Sequence: Synthetic oligonucleotide"
cuucagacaacccagcucu

SEQ ID NO: 172 - RNA, 19 nt, Artificial Sequence
  source: /note="Description of Artificial Sequence: Synthetic oligonucleotide"
agcucugccuuugcggccu

SEQ ID NO: 173 - RNA, 19 nt, Artificial Sequence
  source: /note="Description of Artificial Sequence: Synthetic oligonucleotide"
uucgugaaacgggcaccca

SEQ ID NO: 174 - RNA, 19 nt, Artificial Sequence
  source: /note="Description of Artificial Sequence: Synthetic oligonucleotide"
cagcaccuggcugaccgca

SEQ ID NO: 175 - RNA, 19 nt, Artificial Sequence
  source: /note="Description of Artificial Sequence: Synthetic oligonucleotide"
uacguggucaaggucuucu

SEQ ID NO: 176 - RNA, 19 nt, Artificial Sequence
  source: /note="Description of Artificial Sequence: Synthetic oligonucleotide"
cucucuggcugucaaccua

SEQ ID NO: 177 - RNA, 19 nt, Artificial Sequence
  source: /note="Description of Artificial Sequence: Synthetic oligonucleotide"
uggcugauccuggagaaga

SEQ ID NO: 178 - RNA, 19 nt, Artificial Sequence
  source: /note="Description of Artificial Sequence: Synthetic oligonucleotide"
cagaagcccgacggggucu

SEQ ID NO: 179 - RNA, 19 nt, Artificial Sequence
  source: /note="Description of Artificial Sequence: Synthetic oligonucleotide"
gucuuccaggaggaugcga

SEQ ID NO: 180 - RNA, 19 nt, Artificial Sequence
  source: /note="Description of Artificial Sequence: Synthetic oligonucleotide"
cccgugauacaccaagaaa

SEQ ID NO: 181 - RNA, 19 nt, Artificial Sequence
  source: /note="Description of Artificial Sequence: Synthetic oligonucleotide"
augauugguggauuacgga

SEQ ID NO: 182 - RNA, 19 nt, Artificial Sequence
  source: /note="Description of Artificial Sequence: Synthetic oligonucleotide"
aacaacaacgagaaagaca

SEQ ID NO: 183 - RNA, 19 nt, Artificial Sequence
  source: /note="Description of Artificial Sequence: Synthetic oligonucleotide"
uuuguucucaucucgcuga

SEQ ID NO: 184 - RNA, 19 nt, Artificial Sequence
  source: /note="Description of Artificial Sequence: Synthetic oligonucleotide"
caggaggcuaaagauauuu

SEQ ID NO: 185 - RNA, 19 nt, Artificial Sequence
  source: /note="Description of Artificial Sequence: Synthetic oligonucleotide"
uugcgaggagcaggucaaa

SEQ ID NO: 186 - RNA, 19 nt, Artificial Sequence
  source: /note="Description of Artificial Sequence: Synthetic oligonucleotide"
acagccugccaggcagcau

SEQ ID NO: 187 - RNA, 19 nt, Artificial Sequence
  source: /note="Description of Artificial Sequence: Synthetic oligonucleotide"
gccugccaggcagcaucaa

SEQ ID NO: 188 - RNA, 19 nt, Artificial Sequence
  source: /note="Description of Artificial Sequence: Synthetic oligonucleotide"
cuaaagcaggagacuuccu

SEQ ID NO: 189 - RNA, 19 nt, Artificial Sequence
  source: /note="Description of Artificial Sequence: Synthetic oligonucleotide"
cuugaagccaacuacauga

SEQ ID NO: 190 - RNA, 19 nt, Artificial Sequence
  source: /note="Description of Artificial Sequence: Synthetic oligonucleotide"
uacaugaaccuacagagau

SEQ ID NO: 191 - RNA, 19 nt, Artificial Sequence
  source: /note="Description of Artificial Sequence: Synthetic oligonucleotide"
auccuacacuguggccauu

SEQ ID NO: 192 - RNA, 19 nt, Artificial Sequence
  source: /note="Description of Artificial Sequence: Synthetic oligonucleotide"
uugcuggcuaugcucugga

SEQ ID NO: 193 - RNA, 19 nt, Artificial Sequence
  source: /note="Description of Artificial Sequence: Synthetic oligonucleotide"
gaaggggccucuucuuaaa

SEQ ID NO: 194 - RNA, 19 nt, Artificial Sequence
  source: /note="Description of Artificial Sequence: Synthetic oligonucleotide"
caaauuucugaccacagca

SEQ ID NO: 195 - RNA, 19 nt, Artificial Sequence
  source: /note="Description of Artificial Sequence: Synthetic oligonucleotide"
caaagauaagaaccgcuga

SEQ ID NO: 196 - RNA, 19 nt, Artificial Sequence
  source: /note="Description of Artificial Sequence: Synthetic oligonucleotide"
gggaggacccugguaagca

SEQ ID NO: 197 - RNA, 19 nt, Artificial Sequence
  source: /note="Description of Artificial Sequence: Synthetic oligonucleotide"
gacccugguaagcagcucu

SEQ ID NO: 198 - RNA, 19 nt, Artificial Sequence
  source: /note="Description of Artificial Sequence: Synthetic oligonucleotide"
uacaacguggaggccacau

SEQ ID NO: 199 - RNA, 19 nt, Artificial Sequence
  source: /note="Description of Artificial Sequence: Synthetic oligonucleotide"
ccuaugcccucuuggcccu

SEQ ID NO: 200 - RNA, 19 nt, Artificial Sequence
  source: /note="Description of Artificial Sequence: Synthetic oligonucleotide"
uacugcagcuaaaagacuu

SEQ ID NO: 201 - RNA, 19 nt, Artificial Sequence
  source: /note="Description of Artificial Sequence: Synthetic oligonucleotide"
cgucgugcguuggcucaau

SEQ ID NO: 202 - RNA, 19 nt, Artificial Sequence
  source: /note="Description of Artificial Sequence: Synthetic oligonucleotide"
caaugaacagagauacuaa

SEQ ID NO: 203 - RNA, 19 nt, Artificial Sequence
  source: /note="Description of Artificial Sequence: Synthetic oligonucleotide"
acggugguggcuauggcua

SEQ ID NO: 204 - RNA, 19 nt, Artificial Sequence
  source: /note="Description of Artificial Sequence: Synthetic oligonucleotide"
ucuacccaggccaccuuca

SEQ ID NO: 205 - RNA, 19 nt, Artificial Sequence
  source: /note="Description of Artificial Sequence: Synthetic oligonucleotide"
uucaugguguuccaagccu

SEQ ID NO: 206 - RNA, 19 nt, Artificial Sequence
  source: /note="Description of Artificial Sequence: Synthetic oligonucleotide"
cuuggcucaauaccaaaag

SEQ ID NO: 207 - RNA, 19 nt, Artificial Sequence
  source: /note="Description of Artificial Sequence: Synthetic oligonucleotide"
aggacgccccugaccacca

SEQ ID NO: 208 - RNA, 19 nt, Artificial Sequence
  source: /note="Description of Artificial Sequence: Synthetic oligonucleotide"
caggaacugaaccuugaua

SEQ ID NO: 209 - RNA, 19 nt, Artificial Sequence
  source: /note="Description of Artificial Sequence: Synthetic oligonucleotide"
uugaugugucccuccaacu

SEQ ID NO: 210 - RNA, 19 nt, Artificial Sequence
  source: /note="Description of Artificial Sequence: Synthetic oligonucleotide"
cugcccagccgcagcucca

SEQ ID NO: 211 - RNA, 19 nt, Artificial Sequence
  source: /note="Description of Artificial Sequence: Synthetic oligonucleotide"
cgcagcuccaagaucacca

SEQ ID NO: 212 - RNA, 19 nt, Artificial Sequence
  source: /note="Description of Artificial Sequence: Synthetic oligonucleotide"
ccaccguauccacugggaa

SEQ ID NO: 213 - RNA, 19 nt, Artificial Sequence
  source: /note="Description of Artificial Sequence: Synthetic oligonucleotide"
ccguauccacugggaaucu

SEQ ID NO: 214 - RNA, 19 nt, Artificial Sequence
  source: /note="Description of Artificial Sequence: Synthetic oligonucleotide"
ugccagccuccugcgauca

SEQ ID NO: 215 - RNA, 19 nt, Artificial Sequence
  source: /note="Description of Artificial Sequence: Synthetic oligonucleotide"
agaagagaccaaggaaaau

SEQ ID NO: 216 - RNA, 19 nt, Artificial Sequence
  source: /note="Description of Artificial Sequence: Synthetic oligonucleotide"
augaggguuucacagucaa

SEQ ID NO: 217 - RNA, 19 nt, Artificial Sequence
  source: /note="Description of Artificial Sequence: Synthetic oligonucleotide"
acagcugaaggaaaaggca

SEQ ID NO: 218 - RNA, 19 nt, Artificial Sequence
  source: /note="Description of Artificial Sequence: Synthetic oligonucleotide"
ccaaggcaccuugucggua

SEQ ID NO: 219 - RNA, 19 nt, Artificial Sequence
  source: /note="Description of Artificial Sequence: Synthetic oligonucleotide"
uugucgguggugacaaugu

SEQ ID NO: 220 - RNA, 19 nt, Artificial Sequence
  source: /note="Description of Artificial Sequence: Synthetic oligonucleotide"
guaccaugcuaaggccaaa

SEQ ID NO: 221 - RNA, 19 nt, Artificial Sequence
  source: /note="Description of Artificial Sequence: Synthetic oligonucleotide"
cuaaggccaaagaucaacu

SEQ ID NO: 222 - RNA, 19 nt, Artificial Sequence
  source: /note="Description of Artificial Sequence: Synthetic oligonucleotide"
caacucaccuguaauaaau

SEQ ID NO: 223 - RNA, 19 nt, Artificial Sequence
  source: /note="Description of Artificial Sequence: Synthetic oligonucleotide"
uucgaccucaaggucacca

SEQ ID NO: 224 - RNA, 19 nt, Artificial Sequence
  source: /note="Description of Artificial Sequence: Synthetic oligonucleotide"
ucaccauaaaaccagcaca

SEQ ID NO: 225 - RNA, 19 nt, Artificial Sequence
  source: /note="Description of Artificial Sequence: Synthetic oligonucleotide"
cggaaacagaaaagaggca

SEQ ID NO: 226 - RNA, 19 nt, Artificial Sequence
  source: /note="Description of Artificial Sequence: Synthetic oligonucleotide"
ucaggaugccaagaacacu

SEQ ID NO: 227 - RNA, 19 nt, Artificial Sequence
  source: /note="Description of Artificial Sequence: Synthetic oligonucleotide"
uaugauccuugagaucugu

SEQ ID NO: 228 - RNA, 19 nt, Artificial Sequence
  source: /note="Description of Artificial Sequence: Synthetic oligonucleotide"
ccagguaccggggagacca

SEQ ID NO: 229 - RNA, 19 nt, Artificial Sequence
  source: /note="Description of Artificial Sequence: Synthetic oligonucleotide"
caggaugccacuaugucua

SEQ ID NO: 230 - RNA, 19 nt, Artificial Sequence
  source: /note="Description of Artificial Sequence: Synthetic oligonucleotide"
cuuugcuccagacacagau

SEQ ID NO: 231 - RNA, 19 nt, Artificial Sequence
  source: /note="Description of Artificial Sequence: Synthetic oligonucleotide"
augaccugaagcagcugga

SEQ ID NO: 232 - RNA, 19 nt, Artificial Sequence
  source: /note="Description of Artificial Sequence: Synthetic oligonucleotide"
uugacagauacaucuccaa

SEQ ID NO: 233 - RNA, 19 nt, Artificial Sequence
  source: /note="Description of Artificial Sequence: Synthetic oligonucleotide"
aaguaugagcuggacaaag

SEQ ID NO: 234 - RNA, 19 nt, Artificial Sequence
  source: /note="Description of Artificial Sequence: Synthetic oligonucleotide"
uaugagcuggacaaagccu

SEQ ID NO: 235 - RNA, 19 nt, Artificial Sequence
  source: /note="Description of Artificial Sequence: Synthetic oligonucleotide"
cuucuccgauaggaacaca

SEQ ID NO: 236 - RNA, 19 nt, Artificial Sequence
  source: /note="Description of Artificial Sequence: Synthetic oligonucleotide"
cccucaucaucuaccugga

SEQ ID NO: 237 - RNA, 19 nt, Artificial Sequence
  source: /note="Description of Artificial Sequence: Synthetic oligonucleotide"
gacaaggucucacacucua

SEQ ID NO: 238 - RNA, 19 nt, Artificial Sequence
  source: /note="Description of Artificial Sequence: Synthetic oligonucleotide"
ucacacucugaggaugacu

SEQ ID NO: 239 - RNA, 19 nt, Artificial Sequence
  source: /note="Description of Artificial Sequence: Synthetic oligonucleotide"
gaggaugacugucuagcuu

SEQ ID NO: 240 - RNA, 19 nt, Artificial Sequence
  source: /note="Description of Artificial Sequence: Synthetic oligonucleotide"
uucaaaguucaccaauacu

SEQ ID NO: 241 - RNA, 19 nt, Artificial Sequence
  source: /note="Description of Artificial Sequence: Synthetic oligonucleotide"
cuuuaauguagagcuuaua

SEQ ID NO: 242 - RNA, 19 nt, Artificial Sequence
  source: /note="Description of Artificial Sequence: Synthetic oligonucleotide"
gucaaggucuacgccuauu

SEQ ID NO: 243 - RNA, 19 nt, Artificial Sequence
  source: /note="Description of Artificial Sequence: Synthetic oligonucleotide"
uacaaccuggaggaaagcu

SEQ ID NO: 244 - RNA, 19 nt, Artificial Sequence
  source: /note="Description of Artificial Sequence: Synthetic oligonucleotide"
cuguacccgguucuaccau

SEQ ID NO: 245 - RNA, 19 nt, Artificial Sequence
  source: /note="Description of Artificial Sequence: Synthetic oligonucleotide"
auccggaaaaggaggauga

SEQ ID NO: 246 - RNA, 19 nt, Artificial Sequence
  source: /note="Description of Artificial Sequence: Synthetic oligonucleotide"
aaaaggaggauggaaagcu

SEQ ID NO: 247 - RNA, 19 nt, Artificial Sequence
  source: /note="Description of Artificial Sequence: Synthetic oligonucleotide"
cugaacaagcucugccgua

SEQ ID NO: 248 - RNA, 19 nt, Artificial Sequence
  source: /note="Description of Artificial Sequence: Synthetic oligonucleotide"
ugaugaacugugccgcugu

SEQ ID NO: 249 - RNA, 19 nt, Artificial Sequence
  source: /note="Description of Artificial Sequence: Synthetic oligonucleotide"
gugcugaggagaauugcuu

SEQ ID NO: 250 - RNA, 19 nt, Artificial Sequence
  source: /note="Description of Artificial Sequence: Synthetic oligonucleotide"
aauugcuucauacaaaagu

SEQ ID NO: 251 - RNA, 19 nt, Artificial Sequence
  source: /note="Description of Artificial Sequence: Synthetic oligonucleotide"
gucggaugacaaggucaca

SEQ ID NO: 252 - RNA, 19 nt, Artificial Sequence
  source: /note="Description of Artificial Sequence: Synthetic oligonucleotide"
cccuggaagaacggcugga

SEQ ID NO: 253 - RNA, 19 nt, Artificial Sequence
  source: /note="Description of Artificial Sequence: Synthetic oligonucleotide"
gacaaggccugugagccaa

SEQ ID NO: 254 - RNA, 19 nt, Artificial Sequence
  source: /note="Description of Artificial Sequence: Synthetic oligonucleotide"
aggccugugagccaggagu

SEQ ID NO: 255 - RNA, 19 nt, Artificial Sequence
  source: /note="Description of Artificial Sequence: Synthetic oligonucleotide"
ccaggaguggacuaugugu

SEQ ID NO: 256 - RNA, 19 nt, Artificial Sequence
  source: /note="Description of Artificial Sequence: Synthetic oligonucleotide"
uacaagacccgacugguca

SEQ ID NO: 257 - RNA, 19 nt, Artificial Sequence
  source: /note="Description of Artificial Sequence: Synthetic oligonucleotide"
uucagcuguccaaugacuu

SEQ ID NO: 258 - RNA, 19 nt, Artificial Sequence
  source: /note="Description of Artificial Sequence: Synthetic oligonucleotide"
uuugacgaguacaucauga

SEQ ID NO: 259 - RNA, 19 nt, Artificial Sequence
  source: /note="Description of Artificial Sequence: Synthetic oligonucleotide"
uacaucauggccauugaga

SEQ ID NO: 260 - RNA, 19 nt, Artificial Sequence
  source: /note="Description of Artificial Sequence: Synthetic oligonucleotide"
cagaccaucaagucaggcu

SEQ ID NO: 261 - RNA, 19 nt, Artificial Sequence
  source: /note="Description of Artificial Sequence: Synthetic oligonucleotide"
cucggaugaggugcagguu

SEQ ID NO: 262 - RNA, 19 nt, Artificial Sequence
  source: /note="Description of Artificial Sequence: Synthetic oligonucleotide"
uucaucagccccaucaagu

SEQ ID NO: 263 - RNA, 19 nt, Artificial Sequence
  source: /note="Description of Artificial Sequence: Synthetic oligonucleotide"
ucaagugcagagaagcccu

SEQ ID NO: 264 - RNA, 19 nt, Artificial Sequence
  source: /note="Description of Artificial Sequence: Synthetic oligonucleotide"
cugaagcuggaggagaaga

SEQ ID NO: 265 - RNA, 19 nt, Artificial Sequence
  source: /note="Description of Artificial Sequence: Synthetic oligonucleotide"
aagcuggaggagaagaaac

SEQ ID NO: 266 - RNA, 19 nt, Artificial Sequence
  source: /note="Description of Artificial Sequence: Synthetic oligonucleotide"
acacuaccucauguggggu

SEQ ID NO: 267 - RNA, 19 nt, Artificial Sequence
  source: /note="Description of Artificial Sequence: Synthetic oligonucleotide"
uucuggggagagaagccca

SEQ ID NO: 268 - RNA, 19 nt, Artificial Sequence
  source: /note="Description of Artificial Sequence: Synthetic oligonucleotide"
uacaucaucgggaaggaca

SEQ ID NO: 269 - RNA, 19 nt, Artificial Sequence
  source: /note="Description of Artificial Sequence: Synthetic oligonucleotide"
cacuuggguggagcacuga

SEQ ID NO: 270 - RNA, 19 nt, Artificial Sequence
  source: /note="Description of Artificial Sequence: Synthetic oligonucleotide"
aggacgaaugccaagacga

SEQ ID NO: 271 - RNA, 19 nt, Artificial Sequence
  source: /note="Description of Artificial Sequence: Synthetic oligonucleotide"
aagagaaccagaaacaaua

SEQ ID NO: 272 - RNA, 19 nt, Artificial Sequence
  source: /note="Description of Artificial Sequence: Synthetic oligonucleotide"
ugccaggaccucggcgccu

SEQ ID NO: 273 - RNA, 19 nt, Artificial Sequence
  source: /note="Description of Artificial Sequence: Synthetic oligonucleotide"
cuucaccgagagcaugguu

SEQ ID NO: 274 - RNA, 19 nt, Artificial Sequence
  source: /note="Description of Artificial Sequence: Synthetic oligonucleotide"
cacacccccauucccccaa

SEQ ID NO: 275 - RNA, 19 nt, Artificial Sequence
  source: /note="Description of Artificial Sequence: Synthetic oligonucleotide"
cuccagauaaagcuucagu

SEQ ID NO: 276 - RNA, 19 nt, Artificial Sequence
  source: /note="Description of Artificial Sequence: Synthetic oligonucleotide"
uuauaucucaaaaaaaaaa

SEQ ID NO: 277 - RNA, 19 nt, Artificial Sequence
  source: /note="Description of Artificial Sequence: Synthetic oligonucleotide"
agaggauggggaggaguga

SEQ ID NO: 278 - RNA, 19 nt, Artificial Sequence
  source: /note="Description of Artificial Sequence: Synthetic oligonucleotide"
agagggacagagggacaga

SEQ ID NO: 279 - RNA, 19 nt, Artificial Sequence
  source: /note="Description of Artificial Sequence: Synthetic oligonucleotide"
ugugggucccauggugcug

SEQ ID NO: 280 - RNA, 19 nt, Artificial Sequence
  source: /note="Description of Artificial Sequence: Synthetic oligonucleotide"
agcaggcugggaccugagg

SEQ ID NO: 281 - RNA, 19 nt, Artificial Sequence
  source: /note="Description of Artificial Sequence: Synthetic oligonucleotide"
agcaggagcagcaggcugg

SEQ ID NO: 282 - RNA, 19 nt, Artificial Sequence
  source: /note="Description of Artificial Sequence: Synthetic oligonucleotide"
agggggagguggguuagua

SEQ ID NO: 283 - RNA, 19 nt, Artificial Sequence
  source: /note="Description of Artificial Sequence: Synthetic oligonucleotide"
ugggggugaugauagagua

SEQ ID NO: 284 - RNA, 19 nt, Artificial Sequence
  source: /note="Description of Artificial Sequence: Synthetic oligonucleotide"
uuccagccgcaagauguug

SEQ ID NO: 285 - RNA, 19 nt, Artificial Sequence
  source: /note="Description of Artificial Sequence: Synthetic oligonucleotide"
accauggucuccucgcucu

SEQ ID NO: 286 - RNA, 19 nt, Artificial Sequence
  source: /note="Description of Artificial Sequence: Synthetic oligonucleotide"
acaguaacagugacuggaa

SEQ ID NO: 287 - RNA, 19 nt, Artificial Sequence
  source: /note="Description of Artificial Sequence: Synthetic oligonucleotide"
uuaguuuuuugccugggaa

SEQ ID NO: 288 - RNA, 19 nt, Artificial Sequence
  source: /note="Description of Artificial Sequence: Synthetic oligonucleotide"
uuucucacuggacagcacu

SEQ ID NO: 289 - RNA, 19 nt, Artificial Sequence
  source: /note="Description of Artificial Sequence: Synthetic oligonucleotide"
ucaggggucagcacagucu

SEQ ID NO: 290 - RNA, 19 nt, Artificial Sequence
  source: /note="Description of Artificial Sequence: Synthetic oligonucleotide"
uucugacuugaacucccug

SEQ ID NO: 291 - RNA, 19 nt, Artificial Sequence
  source: /note="Description of Artificial Sequence: Synthetic oligonucleotide"
uccccuuuucugacuugaa

SEQ ID NO: 292 - RNA, 19 nt, Artificial Sequence
  source: /note="Description of Artificial Sequence: Synthetic oligonucleotide"
uggccugcacggucacgaa

SEQ ID NO: 293 - RNA, 19 nt, Artificial Sequence
  source: /note="Description of Artificial Sequence: Synthetic oligonucleotide"
uggucccgaagguggccug

SEQ ID NO: 294 - RNA, 19 nt, Artificial Sequence
  source: /note="Description of Artificial Sequence: Synthetic oligonucleotide"
ucaccuucuccaccacuug

SEQ ID NO: 295 - RNA, 19 nt, Artificial Sequence
  source: /note="Description of Artificial Sequence: Synthetic oligonucleotide"
ucugcaggcugaccagcac

SEQ ID NO: 296 - RNA, 19 nt, Artificial Sequence
  source: /note="Description of Artificial Sequence: Synthetic oligonucleotide"
ugaugaagagguacccgcu

SEQ ID NO: 297 - RNA, 19 nt, Artificial Sequence
  source: /note="Description of Artificial Sequence: Synthetic oligonucleotide"
agauggucuugucugucug

SEQ ID NO: 298 - RNA, 19 nt, Artificial Sequence
  source: /note="Description of Artificial Sequence: Synthetic oligonucleotide"
uguggagccagggguguag

SEQ ID NO: 299 - RNA, 19 nt, Artificial Sequence
  source: /note="Description of Artificial Sequence: Synthetic oligonucleotide"
agauccgauagagaacugu

SEQ ID NO: 300 - RNA, 19 nt, Artificial Sequence
  source: /note="Description of Artificial Sequence: Synthetic oligonucleotide"
ucuugugguugacggugaa

SEQ ID NO: 301 - RNA, 19 nt, Artificial Sequence
  source: /note="Description of Artificial Sequence: Synthetic oligonucleotide"
auguugaccaugaccgucc

SEQ ID NO: 302 - RNA, 19 nt, Artificial Sequence
  source: /note="Description of Artificial Sequence: Synthetic oligonucleotide"
augccuuccggguucucaa

SEQ ID NO: 303 - RNA, 19 nt, Artificial Sequence
  source: /note="Description of Artificial Sequence: Synthetic oligonucleotide"
aguccugcuugaccgggau

SEQ ID NO: 304 - RNA, 19 nt, Artificial Sequence
  source: /note="Description of Artificial Sequence: Synthetic oligonucleotide"
uuucugagaagacaaggag

SEQ ID NO: 305 - RNA, 19 nt, Artificial Sequence
  source: /note="Description of Artificial Sequence: Synthetic oligonucleotide"
ucugguucugagaagacaa

SEQ ID NO: 306 - RNA, 19 nt, Artificial Sequence
  source: /note="Description of Artificial Sequence: Synthetic oligonucleotide"
uaagggcaagacgccaagc

SEQ ID NO: 307 - RNA, 19 nt, Artificial Sequence
  source: /note="Description of Artificial Sequence: Synthetic oligonucleotide"
augucccaagacaagggca

SEQ ID NO: 308 - RNA, 19 nt, Artificial Sequence
  source: /note="Description of Artificial Sequence: Synthetic oligonucleotide"
ugaucuuccacuggcccau

SEQ ID NO: 309 - RNA, 19 nt, Artificial Sequence
  source: /note="Description of Artificial Sequence: Synthetic oligonucleotide"
ucucggaucuuccacuggc

SEQ ID NO: 310 - RNA, 19 nt, Artificial Sequence
  source: /note="Description of Artificial Sequence: Synthetic oligonucleotide"
ugugaguuuucauaguagg

SEQ ID NO: 311 - RNA, 19 nt, Artificial Sequence
  source: /note="Description of Artificial Sequence: Synthetic oligonucleotide"
uuucaccucaaacucagug

SEQ ID NO: 312 - RNA, 19 nt, Artificial Sequence
  source: /note="Description of Artificial Sequence: Synthetic oligonucleotide"
uguacuccuucaccucaaa

SEQ ID NO: 313 - RNA, 19 nt, Artificial Sequence
  source: /note="Description of Artificial Sequence: Synthetic oligonucleotide"
uucgaaacugggcagcacg

SEQ ID NO: 314 - RNA, 19 nt, Artificial Sequence
  source: /note="Description of Artificial Sequence: Synthetic oligonucleotide"
uuaggcuccacuaugaccu

SEQ ID NO: 315 - RNA, 19 nt, Artificial Sequence
  source: /note="Description of Artificial Sequence: Synthetic oligonucleotide"
auguaguagaauuucucug

SEQ ID NO: 316 - RNA, 19 nt, Artificial Sequence
  source: /note="Description of Artificial Sequence: Synthetic oligonucleotide"
aggcccuucucguuauaga

SEQ ID NO: 317 - RNA, 19 nt, Artificial Sequence
  source: /note="Description of Artificial Sequence: Synthetic oligonucleotide"
uggugauggugaccuccag

SEQ ID NO: 318 - RNA, 19 nt, Artificial Sequence
  source: /note="Description of Artificial Sequence: Synthetic oligonucleotide"
ucccguagaggaaccuggc

SEQ ID NO: 319 - RNA, 19 nt, Artificial Sequence
  source: /note="Description of Artificial Sequence: Synthetic oligonucleotide"
uaguucccuccacuuucuu

SEQ ID NO: 320 - RNA, 19 nt, Artificial Sequence
  source: /note="Description of Artificial Sequence: Synthetic oligonucleotide"
agaugacaaaggcaguucc

SEQ ID NO: 321 - RNA, 19 nt, Artificial Sequence
  source: /note="Description of Artificial Sequence: Synthetic oligonucleotide"
ugccauccuggaucccgaa

SEQ ID NO: 322 - RNA, 19 nt, Artificial Sequence
  source: /note="Description of Artificial Sequence: Synthetic oligonucleotide"
uagggaaauccucuguucg

SEQ ID NO: 323 - RNA, 19 nt, Artificial Sequence
  source: /note="Description of Artificial Sequence: Synthetic oligonucleotide"
agggauucaggcagggaaa

SEQ ID NO: 324 - RNA, 19 nt, Artificial Sequence
  source: /note="Description of Artificial Sequence: Synthetic oligonucleotide"
uaaucggaaugcgcuugag

SEQ ID NO: 325 - RNA, 19 nt, Artificial Sequence
  source: /note="Description of Artificial Sequence: Synthetic oligonucleotide"
uucccccgagccauccuca

SEQ ID NO: 326 - RNA, 19 nt, Artificial Sequence
  source: /note="Description of Artificial Sequence: Synthetic oligonucleotide"
uuccggcucagcacaaccu

SEQ ID NO: 327 - RNA, 19 nt, Artificial Sequence
  source: /note="Description of Artificial Sequence: Synthetic oligonucleotide"
aguaccuuccggcucagca

SEQ ID NO: 328 - RNA, 19 nt, Artificial Sequence
  source: /note="Description of Artificial Sequence: Synthetic oligonucleotide"
uaccccguccagcaguacc

SEQ ID NO: 329 - RNA, 19 nt, Artificial Sequence
  source: /note="Description of Artificial Sequence: Synthetic oligonucleotide"
uucugcucggggguucugc

SEQ ID NO: 330 - RNA, 19 nt, Artificial Sequence
  source: /note="Description of Artificial Sequence: Synthetic oligonucleotide"
ugacgguggcagacacgua

SEQ ID NO: 331 - RNA, 19 nt, Artificial Sequence
  source: /note="Description of Artificial Sequence: Synthetic oligonucleotide"
ugucacugccugagugcaa

SEQ ID NO: 332 - RNA, 19 nt, Artificial Sequence
  source: /note="Description of Artificial Sequence: Synthetic oligonucleotide"
aucccgcugcgcucugccu

SEQ ID NO: 333 - RNA, 19 nt, Artificial Sequence
  source: /note="Description of Artificial Sequence: Synthetic oligonucleotide"
acuugggugucuuggugaa

SEQ ID NO: 334 - RNA, 19 nt, Artificial Sequence
  source: /note="Description of Artificial Sequence: Synthetic oligonucleotide"
aguacuugggugucuuggu

SEQ ID NO: 335 - RNA, 19 nt, Artificial Sequence
  source: /note="Description of Artificial Sequence: Synthetic oligonucleotide"
agggcauuccugguuugaa

SEQ ID NO: 336 - RNA, 19 nt, Artificial Sequence
  source: /note="Description of Artificial Sequence: Synthetic oligonucleotide"
ucaucaggguucgucacga

SEQ ID NO: 337 - RNA, 19 nt, Artificial Sequence
  source: /note="Description of Artificial Sequence: Synthetic oligonucleotide"
acaguguccucgcccugga

SEQ ID NO: 338 - RNA, 19 nt, Artificial Sequence
  source: /note="Description of Artificial Sequence: Synthetic oligonucleotide"
uagacugcacaguguccuc

SEQ ID NO: 339 - RNA, 19 nt, Artificial Sequence
  source: /note="Description of Artificial Sequence: Synthetic oligonucleotide"
ugccaucucccuggguuag

SEQ ID NO: 340 - RNA, 19 nt, Artificial Sequence
  source: /note="Description of Artificial Sequence: Synthetic oligonucleotide"
uaugcugaguuuggccacg

SEQ ID NO: 341 - RNA, 19 nt, Artificial Sequence
  source: /note="Description of Artificial Sequence: Synthetic oligonucleotide"
uggcugggguguguguuga

SEQ ID NO: 342 - RNA, 19 nt, Artificial Sequence
  source: /note="Description of Artificial Sequence: Synthetic oligonucleotide"
ugaugcucaagggcuucug

SEQ ID NO: 343 - RNA, 19 nt, Artificial Sequence
  source: /note="Description of Artificial Sequence: Synthetic oligonucleotide"
ugcgcaccgugaugcucaa

SEQ ID NO: 344 - RNA, 19 nt, Artificial Sequence
  source: /note="Description of Artificial Sequence: Synthetic oligonucleotide"
ucucugccuccgagagcuc

SEQ ID NO: 345 - RNA, 19 nt, Artificial Sequence
  source: /note="Description of Artificial Sequence: Synthetic oligonucleotide"
ucaugguccugguagccug

SEQ ID NO: 346 - RNA, 19 nt, Artificial Sequence
  source: /note="Description of Artificial Sequence: Synthetic oligonucleotide"
ucuguagggcagagccugc

SEQ ID NO: 347 - RNA, 19 nt, Artificial Sequence
  source: /note="Description of Artificial Sequence: Synthetic oligonucleotide"
aguugcccacggugcugua

SEQ ID NO: 348 - RNA, 19 nt, Artificial Sequence
  source: /note="Description of Artificial Sequence: Synthetic oligonucleotide"
augcagguaauuguuggag

SEQ ID NO: 349 - RNA, 19 nt, Artificial Sequence
  source: /note="Description of Artificial Sequence: Synthetic oligonucleotide"
agcucuguacguagcacug

SEQ ID NO: 350 - RNA, 19 nt, Artificial Sequence
  source: /note="Description of Artificial Sequence: Synthetic oligonucleotide"
agggucuccccgggucuga

SEQ ID NO: 351 - RNA, 19 nt, Artificial Sequence
  source: /note="Description of Artificial Sequence: Synthetic oligonucleotide"
aucuuggccucgugggcgc

SEQ ID NO: 352 - RNA, 19 nt, Artificial Sequence
  source: /note="Description of Artificial Sequence: Synthetic oligonucleotide"
agguagguguaguagcgga

SEQ ID NO: 353 - RNA, 19 nt, Artificial Sequence
  source: /note="Description of Artificial Sequence: Synthetic oligonucleotide"
ugcccuuguucaugaucag

SEQ ID NO: 354 - RNA, 19 nt, Artificial Sequence
  source: /note="Description of Artificial Sequence: Synthetic oligonucleotide"
ucccgccuucaacagccug

SEQ ID NO: 355 - RNA, 19 nt, Artificial Sequence
  source: /note="Description of Artificial Sequence: Synthetic oligonucleotide"
ugcucucgcaccuggcguc

SEQ ID NO: 356 - RNA, 19 nt, Artificial Sequence
  source: /note="Description of Artificial Sequence: Synthetic oligonucleotide"
ucaccagguccuggccggg

SEQ ID NO: 357 - RNA, 19 nt, Artificial Sequence
  source: /note="Description of Artificial Sequence: Synthetic oligonucleotide"
aguacgccaccaggcggaa

SEQ ID NO: 358 - RNA, 19 nt, Artificial Sequence
  source: /note="Description of Artificial Sequence: Synthetic oligonucleotide"
ugcaccgaucagcguguag

SEQ ID NO: 359 - RNA, 19 nt, Artificial Sequence
  source: /note="Description of Artificial Sequence: Synthetic oligonucleotide"
aguccuugacguccaccca

SEQ ID NO: 360 - RNA, 19 nt, Artificial Sequence
  source: /note="Description of Artificial Sequence: Synthetic oligonucleotide"
accagcgagcccacgcagg

SEQ ID NO: 361 - RNA, 19 nt, Artificial Sequence
  source: /note="Description of Artificial Sequence: Synthetic oligonucleotide"
uacuggccgcuuuuuacca

SEQ ID NO: 362 - RNA, 19 nt, Artificial Sequence
  source: /note="Description of Artificial Sequence: Synthetic oligonucleotide"
acaggcugccggucuucug

SEQ ID NO: 363 - RNA, 19 nt, Artificial Sequence
  source: /note="Description of Artificial Sequence: Synthetic oligonucleotide"
uggucaucugcugcccagg

SEQ ID NO: 364 - RNA, 19 nt, Artificial Sequence
  source: /note="Description of Artificial Sequence: Synthetic oligonucleotide"
ugucacccucuaucuucag

SEQ ID NO: 365 - RNA, 19 nt, Artificial Sequence
  source: /note="Description of Artificial Sequence: Synthetic oligonucleotide"
uaccacccgggccccgugg

SEQ ID NO: 366 - RNA, 19 nt, Artificial Sequence
  source: /note="Description of Artificial Sequence: Synthetic oligonucleotide"
uuuguccacggccaccagu

SEQ ID NO: 367 - RNA, 19 nt, Artificial Sequence
  source: /note="Description of Artificial Sequence: Synthetic oligonucleotide"
ugucaguuuguucuucuua

SEQ ID NO: 368 - RNA, 19 nt, Artificial Sequence
  source: /note="Description of Artificial Sequence: Synthetic oligonucleotide"
ucccagaucuuacucugcg

SEQ ID NO: 369 - RNA, 19 nt, Artificial Sequence
  source: /note="Description of Artificial Sequence: Synthetic oligonucleotide"
uugccuucuccaccacguc

SEQ ID NO: 370 - RNA, 19 nt, Artificial Sequence
  source: /note="Description of Artificial Sequence: Synthetic oligonucleotide"
ucuucccacugcccggggu

SEQ ID NO: 371 - RNA, 19 nt, Artificial Sequence
  source: /note="Description of Artificial Sequence: Synthetic oligonucleotide"
agaagacaccggcguaauc

SEQ ID NO: 372 - RNA, 19 nt, Artificial Sequence
  source: /note="Description of Artificial Sequence: Synthetic oligonucleotide"
aggucagcccugcgucgga

SEQ ID NO: 373 - RNA, 19 nt, Artificial Sequence
  source: /note="Description of Artificial Sequence: Synthetic oligonucleotide"
ugccacugcugcucgugaa

SEQ ID NO: 374 - RNA, 19 nt, Artificial Sequence
  source: /note="Description of Artificial Sequence: Synthetic oligonucleotide"
ucucugggcggucugcugg

SEQ ID NO: 375 - RNA, 19 nt, Artificial Sequence
  source: /note="Description of Artificial Sequence: Synthetic oligonucleotide"
aguucugcccucugggcgg

SEQ ID NO: 376 - RNA, 19 nt, Artificial Sequence
  source: /note="Description of Artificial Sequence: Synthetic oligonucleotide"
ucuggcugcgggcacugaa

SEQ ID NO: 377 - RNA, 19 nt, Artificial Sequence
  source: /note="Description of Artificial Sequence: Synthetic oligonucleotide"
aacggcgucggcgggcggc

SEQ ID NO: 378 - RNA, 19 nt, Artificial Sequence
  source: /note="Description of Artificial Sequence: Synthetic oligonucleotide"
uguccauucgcuucuccgu

SEQ ID NO: 379 - RNA, 19 nt, Artificial Sequence
  source: /note="Description of Artificial Sequence: Synthetic oligonucleotide"
ugggguacuugccgacuuu

SEQ ID NO: 380 - RNA, 19 nt, Artificial Sequence
  source: /note="Description of Artificial Sequence: Synthetic oligonucleotide"
ucacuugcgcagcuccuug

SEQ ID NO: 381 - RNA, 19 nt, Artificial Sequence
  source: /note="Description of Artificial Sequence: Synthetic oligonucleotide"
ugcaugccguccucgcagc

SEQ ID NO: 382 - RNA, 19 nt, Artificial Sequence
  source: /note="Description of Artificial Sequence: Synthetic oligonucleotide"
uggcacgagaaccucaugg

SEQ ID NO: 383 - RNA, 19 nt, Artificial Sequence
  source: /note="Description of Artificial Sequence: Synthetic oligonucleotide"
uccggcgcuggcacgagaa

SEQ ID NO: 384 - RNA, 19 nt, Artificial Sequence
  source: /note="Description of Artificial Sequence: Synthetic oligonucleotide"
ugcccagggagaugaaacg

SEQ ID NO: 385 - RNA, 19 nt, Artificial Sequence
  source: /note="Description of Artificial Sequence: Synthetic oligonucleotide"
agaccuucuugcacgccuc

SEQ ID NO: 386 - RNA, 19 nt, Artificial Sequence
  source: /note="Description of Artificial Sequence: Synthetic oligonucleotide"
aguugcagcaguccaggaa

SEQ ID NO: 387 - RNA, 19 nt, Artificial Sequence
  source: /note="Description of Artificial Sequence: Synthetic oligonucleotide"
ucgcagcucugugauguag

SEQ ID NO: 388 - RNA, 19 nt, Artificial Sequence
  source: /note="Description of Artificial Sequence: Synthetic oligonucleotide"
agguggcuggcccgcgcgu

SEQ ID NO: 389 - RNA, 19 nt, Artificial Sequence
  source: /note="Description of Artificial Sequence: Synthetic oligonucleotide"
uuacuccuggccaggccca

SEQ ID NO: 390 - RNA, 19 nt, Artificial Sequence
  source: /note="Description of Artificial Sequence: Synthetic oligonucleotide"
augauguccucauccaggu

SEQ ID NO: 391 - RNA, 19 nt, Artificial Sequence
  source: /note="Description of Artificial Sequence: Synthetic oligonucleotide"
acgauguucucuucugcaa

SEQ ID NO: 392 - RNA, 19 nt, Artificial Sequence
  source: /note="Description of Artificial Sequence: Synthetic oligonucleotide"
ugaacucacuucgggaaac

SEQ ID NO: 393 - RNA, 19 nt, Artificial Sequence
  source: /note="Description of Artificial Sequence: Synthetic oligonucleotide"
acagccagcucucugggaa

SEQ ID NO: 394 - RNA, 19 nt, Artificial Sequence
  source: /note="Description of Artificial Sequence: Synthetic oligonucleotide"
uaaguccucaacguuccac

SEQ ID NO: 395 - RNA, 19 nt, Artificial Sequence
  source: /note="Description of Artificial Sequence: Synthetic oligonucleotide"
ugcucuuucaaguccucaa

SEQ ID NO: 396 - RNA, 19 nt, Artificial Sequence
  source: /note="Description of Artificial Sequence: Synthetic oligonucleotide"
uguggcucuuucaaguccu

SEQ ID NO: 397 - RNA, 19 nt, Artificial Sequence
  source: /note="Description of Artificial Sequence: Synthetic oligonucleotide"
uuagagauuccauuuuucg

SEQ ID NO: 398 - RNA, 19 nt, Artificial Sequence
  source: /note="Description of Artificial Sequence: Synthetic oligonucleotide"
auucaugagcuucguagag

SEQ ID NO: 399 - RNA, 19 nt, Artificial Sequence
  source: /note="Description of Artificial Sequence: Synthetic oligonucleotide"
ugagucuuucaaaaauaua

SEQ ID NO: 400 - RNA, 19 nt, Artificial Sequence
  source: /note="Description of Artificial Sequence: Synthetic oligonucleotide"
aucucccacguggugaugg

SEQ ID NO: 401 - RNA, 19 nt, Artificial Sequence
  source: /note="Description of Artificial Sequence: Synthetic oligonucleotide"
acaugcucacagccagaau

SEQ ID NO: 402 - RNA, 19 nt, Artificial Sequence
  source: /note="Description of Artificial Sequence: Synthetic oligonucleotide"
agaucccuuucuuguccga

SEQ ID NO: 403 - RNA, 19 nt, Artificial Sequence
  source: /note="Description of Artificial Sequence: Synthetic oligonucleotide"
ugaccucgaaggggucugc

SEQ ID NO: 404 - RNA, 19 nt, Artificial Sequence
  source: /note="Description of Artificial Sequence: Synthetic oligonucleotide"
uuagccgcaggucgaugaa

SEQ ID NO: 405 - RNA, 19 nt, Artificial Sequence
  source: /note="Description of Artificial Sequence: Synthetic oligonucleotide"
ucgaacaacagaguagggu

SEQ ID NO: 406 - RNA, 19 nt, Artificial Sequence
  source: /note="Description of Artificial Sequence: Synthetic oligonucleotide"
ugcucguuucgaacaacag

SEQ ID NO: 407 - RNA, 19 nt, Artificial Sequence
  source: /note="Description of Artificial Sequence: Synthetic oligonucleotide"
uggcucggauuuccaccug

SEQ ID NO: 408 - RNA, 19 nt, Artificial Sequence
  source: /note="Description of Artificial Sequence: Synthetic oligonucleotide"
ucgguaauuguagagaacg

SEQ ID NO: 409 - RNA, 19 nt, Artificial Sequence
  source: /note="Description of Artificial Sequence: Synthetic oligonucleotide"
acccucaccuugagcucuu

SEQ ID NO: 410 - RNA, 19 nt, Artificial Sequence
  source: /note="Description of Artificial Sequence: Synthetic oligonucleotide"
uauuguggaguaguuccac

SEQ ID NO: 411 - RNA, 19 nt, Artificial Sequence
  source: /note="Description of Artificial Sequence: Synthetic oligonucleotide"
aaggcuggauuguggagua

SEQ ID NO: 412 - RNA, 19 nt, Artificial Sequence
  source: /note="Description of Artificial Sequence: Synthetic oligonucleotide"
ugguggccaggcugcagaa

SEQ ID NO: 413 - RNA, 19 nt, Artificial Sequence
  source: /note="Description of Artificial Sequence: Synthetic oligonucleotide"
uuggugacgccucuuggug

SEQ ID NO: 414 - RNA, 19 nt, Artificial Sequence
  source: /note="Description of Artificial Sequence: Synthetic oligonucleotide"
uggaugguuacggucugcu

SEQ ID NO: 415 - RNA, 19 nt, Artificial Sequence
  source: /note="Description of Artificial Sequence: Synthetic oligonucleotide"
auggaacggacaacgagga

SEQ ID NO: 416 - RNA, 19 nt, Artificial Sequence
  source: /note="Description of Artificial Sequence: Synthetic oligonucleotide"
uuagcggcacgaugacaua

SEQ ID NO: 417 - RNA, 19 nt, Artificial Sequence
  source: /note="Description of Artificial Sequence: Synthetic oligonucleotide"
acuuccugcaggccggucu

SEQ ID NO: 418 - RNA, 19 nt, Artificial Sequence
  source: /note="Description of Artificial Sequence: Synthetic oligonucleotide"
uagcagccuugacuuccac

SEQ ID NO: 419 - RNA, 19 nt, Artificial Sequence
  source: /note="Description of Artificial Sequence: Synthetic oligonucleotide"
ugacaccgucacugaugaa

SEQ ID NO: 420 - RNA, 19 nt, Artificial Sequence
  source: /note="Description of Artificial Sequence: Synthetic oligonucleotide"
uaccuucagggacuuccug

SEQ ID NO: 421 - RNA, 19 nt, Artificial Sequence
  source: /note="Description of Artificial Sequence: Synthetic oligonucleotide"
aguuuuguucauucugauu

SEQ ID NO: 422 - RNA, 19 nt, Artificial Sequence
  source: /note="Description of Artificial Sequence: Synthetic oligonucleotide"
agggugcgaacagccacag

SEQ ID NO: 423 - RNA, 19 nt, Artificial Sequence
  source: /note="Description of Artificial Sequence: Synthetic oligonucleotide"
ucaggcguucuggauccag

SEQ ID NO: 424 - RNA, 19 nt, Artificial Sequence
  source: /note="Description of Artificial Sequence: Synthetic oligonucleotide"
uccucuuucugcacuccuu

SEQ ID NO: 425 - RNA, 19 nt, Artificial Sequence
  source: /note="Description of Artificial Sequence: Synthetic oligonucleotide"
uuguccgggacuuggucac

SEQ ID NO: 426 - RNA, 19 nt, Artificial Sequence
  source: /note="Description of Artificial Sequence: Synthetic oligonucleotide"
auucuggucucagacucgg

SEQ ID NO: 427 - RNA, 19 nt, Artificial Sequence
  source: /note="Description of Artificial Sequence: Synthetic oligonucleotide"
ugggucccuugcaggagaa

SEQ ID NO: 428 - RNA, 19 nt, Artificial Sequence
  source: /note="Description of Artificial Sequence: Synthetic oligonucleotide"
uugucaucugggccacugg

SEQ ID NO: 429 - RNA, 19 nt, Artificial Sequence
  source: /note="Description of Artificial Sequence: Synthetic oligonucleotide"
uagccguuccgcgucgacg

SEQ ID NO: 430 - RNA, 19 nt, Artificial Sequence
  source: /note="Description of Artificial Sequence: Synthetic oligonucleotide"
uaucauguucuguuccccg

SEQ ID NO: 431 - RNA, 19 nt, Artificial Sequence
  source: /note="Description of Artificial Sequence: Synthetic oligonucleotide"
accgugggcgucaugccga

SEQ ID NO: 432 - RNA, 19 nt, Artificial Sequence
  source: /note="Description of Artificial Sequence: Synthetic oligonucleotide"
ucuccguuucauccaggua

SEQ ID NO: 433 - RNA, 19 nt, Artificial Sequence
  source: /note="Description of Artificial Sequence: Synthetic oligonucleotide"
uacugcuccguuucaucca

SEQ ID NO: 434 - RNA, 19 nt, Artificial Sequence
  source: /note="Description of Artificial Sequence: Synthetic oligonucleotide"
ucuaggccgaacuucuccc

SEQ ID NO: 435 - RNA, 19 nt, Artificial Sequence
  source: /note="Description of Artificial Sequence: Synthetic oligonucleotide"
aaggcccccugccgcuucu

SEQ ID NO: 436 - RNA, 19 nt, Artificial Sequence
  source: /note="Description of Artificial Sequence: Synthetic oligonucleotide"
ucuucuugaugagcuccaa

SEQ ID NO: 437 - RNA, 19 nt, Artificial Sequence
  source: /note="Description of Artificial Sequence: Synthetic oligonucleotide"
accccuucuugaugagcuc

SEQ ID NO: 438 - RNA, 19 nt, Artificial Sequence
  source: /note="Description of Artificial Sequence: Synthetic oligonucleotide"
aggccagcugcugggugua

SEQ ID NO: 439 - RNA, 19 nt, Artificial Sequence
  source: /note="Description of Artificial Sequence: Synthetic oligonucleotide"
agagcuggguugucugaag

SEQ ID NO: 440 - RNA, 19 nt, Artificial Sequence
  source: /note="Description of Artificial Sequence: Synthetic oligonucleotide"
aggccgcaaaggcagagcu

SEQ ID NO: 441 - RNA, 19 nt, Artificial Sequence
  source: /note="Description of Artificial Sequence: Synthetic oligonucleotide"
ugggugcccguuucacgaa

SEQ ID NO: 442 - RNA, 19 nt, Artificial Sequence
  source: /note="Description of Artificial Sequence: Synthetic oligonucleotide"
ugcggucagccaggugcug

SEQ ID NO: 443 - RNA, 19 nt, Artificial Sequence
  source: /note="Description of Artificial Sequence: Synthetic oligonucleotide"
agaagaccuugaccacgua

SEQ ID NO: 444 - RNA, 19 nt, Artificial Sequence
  source: /note="Description of Artificial Sequence: Synthetic oligonucleotide"
uagguugacagccagagag

SEQ ID NO: 445 - RNA, 19 nt, Artificial Sequence
  source: /note="Description of Artificial Sequence: Synthetic oligonucleotide"
ucuucuccaggaucagcca

SEQ ID NO: 446 - RNA, 19 nt, Artificial Sequence
  source: /note="Description of Artificial Sequence: Synthetic oligonucleotide"
agaccccgucgggcuucug

SEQ ID NO: 447 - RNA, 19 nt, Artificial Sequence
  source: /note="Description of Artificial Sequence: Synthetic oligonucleotide"
ucgcauccuccuggaagac

SEQ ID NO: 448 - RNA, 19 nt, Artificial Sequence
  source: /note="Description of Artificial Sequence: Synthetic oligonucleotide"
uuucuugguguaucacggg

SEQ ID NO: 449 - RNA, 19 nt, Artificial Sequence
  source: /note="Description of Artificial Sequence: Synthetic oligonucleotide"
uccguaauccaccaaucau

SEQ ID NO: 450 - RNA, 19 nt, Artificial Sequence
  source: /note="Description of Artificial Sequence: Synthetic oligonucleotide"
ugucuuucucguuguuguu

SEQ ID NO: 451 - RNA, 19 nt, Artificial Sequence
  source: /note="Description of Artificial Sequence: Synthetic oligonucleotide"
ucagcgagaugagaacaaa

SEQ ID NO: 452 - RNA, 19 nt, Artificial Sequence
  source: /note="Description of Artificial Sequence: Synthetic oligonucleotide"
aaauaucuuuagccuccug

SEQ ID NO: 453 - RNA, 19 nt, Artificial Sequence
  source: /note="Description of Artificial Sequence: Synthetic oligonucleotide"
uuugaccugcuccucgcaa

SEQ ID NO: 454 - RNA, 19 nt, Artificial Sequence
  source: /note="Description of Artificial Sequence: Synthetic oligonucleotide"
augcugccuggcaggcugu

SEQ ID NO: 455 - RNA, 19 nt, Artificial Sequence
  source: /note="Description of Artificial Sequence: Synthetic oligonucleotide"
uugaugcugccuggcaggc

SEQ ID NO: 456 - RNA, 19 nt, Artificial Sequence
  source: /note="Description of Artificial Sequence: Synthetic oligonucleotide"
aggaagucuccugcuuuag

SEQ ID NO: 457 - RNA, 19 nt, Artificial Sequence
  source: /note="Description of Artificial Sequence: Synthetic oligonucleotide"
ucauguaguuggcuucaag

SEQ ID NO: 458 - RNA, 19 nt, Artificial Sequence
  source: /note="Description of Artificial Sequence: Synthetic oligonucleotide"
aucucuguagguucaugua

SEQ ID NO: 459 - RNA, 19 nt, Artificial Sequence
  source: /note="Description of Artificial Sequence: Synthetic oligonucleotide"
aauggccacaguguaggau

SEQ ID NO: 460 - RNA, 19 nt, Artificial Sequence
  source: /note="Description of Artificial Sequence: Synthetic oligonucleotide"
uccagagcauagccagcaa

SEQ ID NO: 461 - RNA, 19 nt, Artificial Sequence
  source: /note="Description of Artificial Sequence: Synthetic oligonucleotide"
uuuaagaagaggccccuuc

SEQ ID NO: 462 - RNA, 19 nt, Artificial Sequence
  source: /note="Description of Artificial Sequence: Synthetic oligonucleotide"
ugcuguggucagaaauuug

SEQ ID NO: 463 - RNA, 19 nt, Artificial Sequence
  source: /note="Description of Artificial Sequence: Synthetic oligonucleotide"
ucagcgguucuuaucuuug

SEQ ID NO: 464 - RNA, 19 nt, Artificial Sequence
  source: /note="Description of Artificial Sequence: Synthetic oligonucleotide"
ugcuuaccaggguccuccc

SEQ ID NO: 465 - RNA, 19 nt, Artificial Sequence
  source: /note="Description of Artificial Sequence: Synthetic oligonucleotide"
agagcugcuuaccaggguc

SEQ ID NO: 466 - RNA, 19 nt, Artificial Sequence
  source: /note="Description of Artificial Sequence: Synthetic oligonucleotide"
auguggccuccacguugua

SEQ ID NO: 467 - RNA, 19 nt, Artificial Sequence
  source: /note="Description of Artificial Sequence: Synthetic oligonucleotide"
agggccaagagggcauagg

SEQ ID NO: 468 - RNA, 19 nt, Artificial Sequence
  source: /note="Description of Artificial Sequence: Synthetic oligonucleotide"
aagucuuuuagcugcagua

SEQ ID NO: 469 - RNA, 19 nt, Artificial Sequence
  source: /note="Description of Artificial Sequence: Synthetic oligonucleotide"
auugagccaacgcacgacg

SEQ ID NO: 470 - RNA, 19 nt, Artificial Sequence
  source: /note="Description of Artificial Sequence: Synthetic oligonucleotide"
uuaguaucucuguucauug

SEQ ID NO: 471 - RNA, 19 nt, Artificial Sequence
  source: /note="Description of Artificial Sequence: Synthetic oligonucleotide"
uagccauagccaccaccgu

SEQ ID NO: 472 - RNA, 19 nt, Artificial Sequence
  source: /note="Description of Artificial Sequence: Synthetic oligonucleotide"
ugaagguggccuggguaga

SEQ ID NO: 473 - RNA, 19 nt, Artificial Sequence
  source: /note="Description of Artificial Sequence: Synthetic oligonucleotide"
aggcuuggaacaccaugaa

SEQ ID NO: 474 - RNA, 19 nt, Artificial Sequence
  source: /note="Description of Artificial Sequence: Synthetic oligonucleotide"
cuuuugguauugagccaag

SEQ ID NO: 475 - RNA, 19 nt, Artificial Sequence
  source: /note="Description of Artificial Sequence: Synthetic oligonucleotide"
ugguggucaggggcguccu

SEQ ID NO: 476 - RNA, 19 nt, Artificial Sequence
  source: /note="Description of Artificial Sequence: Synthetic oligonucleotide"
uaucaagguucaguuccug

SEQ ID NO: 477 - RNA, 19 nt, Artificial Sequence
  source: /note="Description of Artificial Sequence: Synthetic oligonucleotide"
aguuggagggacacaucaa

SEQ ID NO: 478 - RNA, 19 nt, Artificial Sequence
  source: /note="Description of Artificial Sequence: Synthetic oligonucleotide"
uggagcugcggcugggcag

SEQ ID NO: 479 - RNA, 19 nt, Artificial Sequence
  source: /note="Description of Artificial Sequence: Synthetic oligonucleotide"
uggugaucuuggagcugcg

SEQ ID NO: 480 - RNA, 19 nt, Artificial Sequence
  source: /note="Description of Artificial Sequence: Synthetic oligonucleotide"
uucccaguggauacggugg

SEQ ID NO: 481 - RNA, 19 nt, Artificial Sequence
  source: /note="Description of Artificial Sequence: Synthetic oligonucleotide"
agauucccaguggauacgg

SEQ ID NO: 482 - RNA, 19 nt, Artificial Sequence
  source: /note="Description of Artificial Sequence: Synthetic oligonucleotide"
ugaucgcaggaggcuggca

SEQ ID NO: 483 - RNA, 19 nt, Artificial Sequence
  source: /note="Description of Artificial Sequence: Synthetic oligonucleotide"
auuuuccuuggucucuucu

SEQ ID NO: 484 - RNA, 19 nt, Artificial Sequence
  source: /note="Description of Artificial Sequence: Synthetic oligonucleotide"
uugacugugaaacccucau

SEQ ID NO: 485 - RNA, 19 nt, Artificial Sequence
  source: /note="Description of Artificial Sequence: Synthetic oligonucleotide"
ugccuuuuccuucagcugu

SEQ ID NO: 486 - RNA, 19 nt, Artificial Sequence
  source: /note="Description of Artificial Sequence: Synthetic oligonucleotide"
uaccgacaaggugccuugg

SEQ ID NO: 487 - RNA, 19 nt, Artificial Sequence
  source: /note="Description of Artificial Sequence: Synthetic oligonucleotide"
acauugucaccaccgacaa

SEQ ID NO: 488 - RNA, 19 nt, Artificial Sequence
  source: /note="Description of Artificial Sequence: Synthetic oligonucleotide"
uuuggccuuagcaugguac

SEQ ID NO: 489 - RNA, 19 nt, Artificial Sequence
  source: /note="Description of Artificial Sequence: Synthetic oligonucleotide"
aguugaucuuuggccuuag

SEQ ID NO: 490 - RNA, 19 nt, Artificial Sequence
  source: /note="Description of Artificial Sequence: Synthetic oligonucleotide"
auuuauuacaggugaguug

SEQ ID NO: 491 - RNA, 19 nt, Artificial Sequence
  source: /note="Description of Artificial Sequence: Synthetic oligonucleotide"
uggugaccuugaggucgaa

SEQ ID NO: 492 - RNA, 19 nt, Artificial Sequence
  source: /note="Description of Artificial Sequence: Synthetic oligonucleotide"
ugugcugguuuuaugguga

SEQ ID NO: 493 - RNA, 19 nt, Artificial Sequence
  source: /note="Description of Artificial Sequence: Synthetic oligonucleotide"
ugccucuuuucuguuuccg

SEQ ID NO: 494 - RNA, 19 nt, Artificial Sequence
  source: /note="Description of Artificial Sequence: Synthetic oligonucleotide"
aguguucuuggcauccuga

SEQ ID NO: 495 - RNA, 19 nt, Artificial Sequence
  source: /note="Description of Artificial Sequence: Synthetic oligonucleotide"
acagaucucaaggaucaua

SEQ ID NO: 496 - RNA, 19 nt, Artificial Sequence
  source: /note="Description of Artificial Sequence: Synthetic oligonucleotide"
uggucuccccgguaccugg

SEQ ID NO: 497 - RNA, 19 nt, Artificial Sequence
  source: /note="Description of Artificial Sequence: Synthetic oligonucleotide"
uagacauaguggcauccug

SEQ ID NO: 498 - RNA, 19 nt, Artificial Sequence
  source: /note="Description of Artificial Sequence: Synthetic oligonucleotide"
aucugugucuggagcaaag

SEQ ID NO: 499 - RNA, 19 nt, Artificial Sequence
  source: /note="Description of Artificial Sequence: Synthetic oligonucleotide"
uccagcugcuucaggucau

SEQ ID NO: 500 - RNA, 19 nt, Artificial Sequence
  source: /note="Description of Artificial Sequence: Synthetic oligonucleotide"
uuggagauguaucugucaa

SEQ ID NO: 501 - RNA, 19 nt, Artificial Sequence
  source: /note="Description of Artificial Sequence: Synthetic oligonucleotide"
cuuuguccagcucauacuu

SEQ ID NO: 502 - RNA, 19 nt, Artificial Sequence
  source: /note="Description of Artificial Sequence: Synthetic oligonucleotide"
aggcuuuguccagcucaua

SEQ ID NO: 503 - RNA, 19 nt, Artificial Sequence
  source: /note="Description of Artificial Sequence: Synthetic oligonucleotide"
uguguuccuaucggagaag

SEQ ID NO: 504 - RNA, 19 nt, Artificial Sequence
  source: /note="Description of Artificial Sequence: Synthetic oligonucleotide"
uccagguagaugaugaggg

SEQ ID NO: 505 - RNA, 19 nt, Artificial Sequence
  source: /note="Description of Artificial Sequence: Synthetic oligonucleotide"
uagagugugagaccuuguc

SEQ ID NO: 506 - RNA, 19 nt, Artificial Sequence
  source: /note="Description of Artificial Sequence: Synthetic oligonucleotide"
agucauccucagaguguga

SEQ ID NO: 507 - RNA, 19 nt, Artificial Sequence
  source: /note="Description of Artificial Sequence: Synthetic oligonucleotide"
aagcuagacagucauccuc

SEQ ID NO: 508 - RNA, 19 nt, Artificial Sequence
  source: /note="Description of Artificial Sequence: Synthetic oligonucleotide"
aguauuggugaacuuugaa

SEQ ID NO: 509 - RNA, 19 nt, Artificial Sequence
  source: /note="Description of Artificial Sequence: Synthetic oligonucleotide"
uauaagcucuacauuaaag

SEQ ID NO: 510 - RNA, 19 nt, Artificial Sequence
  source: /note="Description of Artificial Sequence: Synthetic oligonucleotide"
aauaggcguagaccuugac

SEQ ID NO: 511 - RNA, 19 nt, Artificial Sequence
  source: /note="Description of Artificial Sequence: Synthetic oligonucleotide"
agcuuuccuccagguugua

SEQ ID NO: 512 - RNA, 19 nt, Artificial Sequence
  source: /note="Description of Artificial Sequence: Synthetic oligonucleotide"
augguagaaccggguacag

SEQ ID NO: 513 - RNA, 19 nt, Artificial Sequence
  source: /note="Description of Artificial Sequence: Synthetic oligonucleotide"
ucauccuccuuuuccggau

SEQ ID NO: 514 - RNA, 19 nt, Artificial Sequence
  source: /note="Description of Artificial Sequence: Synthetic oligonucleotide"
agcuuuccauccuccuuuu

SEQ ID NO: 515 - RNA, 19 nt, Artificial Sequence
  source: /note="Description of Artificial Sequence: Synthetic oligonucleotide"
uacggcagagcuuguucag

SEQ ID NO: 516 - RNA, 19 nt, Artificial Sequence
  source: /note="Description of Artificial Sequence: Synthetic oligonucleotide"
acagcggcacaguucauca

SEQ ID NO: 517 - RNA, 19 nt, Artificial Sequence
  source: /note="Description of Artificial Sequence: Synthetic oligonucleotide"
aagcaauucuccucagcac

SEQ ID NO: 518 - RNA, 19 nt, Artificial Sequence
  source: /note="Description of Artificial Sequence: Synthetic oligonucleotide"
acuuuuguaugaagcaauu

SEQ ID NO: 519 - RNA, 19 nt, Artificial Sequence
  source: /note="Description of Artificial Sequence: Synthetic oligonucleotide"
ugugaccuugucauccgac

SEQ ID NO: 520 - RNA, 19 nt, Artificial Sequence
  source: /note="Description of Artificial Sequence: Synthetic oligonucleotide"
uccagccguucuuccaggg

SEQ ID NO: 521 - RNA, 19 nt, Artificial Sequence
  source: /note="Description of Artificial Sequence: Synthetic oligonucleotide"
uuggcucacaggccuuguc

SEQ ID NO: 522 - RNA, 19 nt, Artificial Sequence
  source: /note="Description of Artificial Sequence: Synthetic oligonucleotide"
acuccuggcucacaggccu

SEQ ID NO: 523 - RNA, 19 nt, Artificial Sequence
  source: /note="Description of Artificial Sequence: Synthetic oligonucleotide"
acacauaguccacuccugg

SEQ ID NO: 524 - RNA, 19 nt, Artificial Sequence
  source: /note="Description of Artificial Sequence: Synthetic oligonucleotide"
ugaccagucgggucuugua

SEQ ID NO: 525 - RNA, 19 nt, Artificial Sequence
  source: /note="Description of Artificial Sequence: Synthetic oligonucleotide"
aagucauuggacagcugaa

SEQ ID NO: 526 - RNA, 19 nt, Artificial Sequence
  source: /note="Description of Artificial Sequence: Synthetic oligonucleotide"
ucaugauguacucgucaaa

SEQ ID NO: 527 - RNA, 19 nt, Artificial Sequence
  source: /note="Description of Artificial Sequence: Synthetic oligonucleotide"
ucucaauggccaugaugua

SEQ ID NO: 528 - RNA, 19 nt, Artificial Sequence
  source: /note="Description of Artificial Sequence: Synthetic oligonucleotide"
agccugacuugauggucug

SEQ ID NO: 529 - RNA, 19 nt, Artificial Sequence
  source: /note="Description of Artificial Sequence: Synthetic oligonucleotide"
aaccugcaccucauccgag

SEQ ID NO: 530 - RNA, 19 nt, Artificial Sequence
  source: /note="Description of Artificial Sequence: Synthetic oligonucleotide"
acuugauggggcugaugaa

SEQ ID NO: 531 - RNA, 19 nt, Artificial Sequence
  source: /note="Description of Artificial Sequence: Synthetic oligonucleotide"
agggcuucucugcacuuga

SEQ ID NO: 532 - RNA, 19 nt, Artificial Sequence
  source: /note="Description of Artificial Sequence: Synthetic oligonucleotide"
ucuucuccuccagcuucag

SEQ ID NO: 533 - RNA, 19 nt, Artificial Sequence
  source: /note="Description of Artificial Sequence: Synthetic oligonucleotide"
guuucuucuccuccagcuu

SEQ ID NO: 534 - RNA, 19 nt, Artificial Sequence
  source: /note="Description of Artificial Sequence: Synthetic oligonucleotide"
accccacaugagguagugu

SEQ ID NO: 535 - RNA, 19 nt, Artificial Sequence
  source: /note="Description of Artificial Sequence: Synthetic oligonucleotide"
ugggcuucucuccccagaa

SEQ ID NO: 536 - RNA, 19 nt, Artificial Sequence
  source: /note="Description of Artificial Sequence: Synthetic oligonucleotide"
uguccuucccgaugaugua

SEQ ID NO: 537 - RNA, 19 nt, Artificial Sequence
  source: /note="Description of Artificial Sequence: Synthetic oligonucleotide"
ucagugcuccacccaagug

SEQ ID NO: 538 - RNA, 19 nt, Artificial Sequence
  source: /note="Description of Artificial Sequence: Synthetic oligonucleotide"
ucgucuuggcauucguccu

SEQ ID NO: 539 - RNA, 19 nt, Artificial Sequence
  source: /note="Description of Artificial Sequence: Synthetic oligonucleotide"
uauuguuucugguucucuu

SEQ ID NO: 540 - RNA, 19 nt, Artificial Sequence
  source: /note="Description of Artificial Sequence: Synthetic oligonucleotide"
aggcgccgagguccuggca

SEQ ID NO: 541 - RNA, 19 nt, Artificial Sequence
  source: /note="Description of Artificial Sequence: Synthetic oligonucleotide"
aaccaugcucucggugaag

SEQ ID NO: 542 - RNA, 19 nt, Artificial Sequence
  source: /note="Description of Artificial Sequence: Synthetic oligonucleotide"
uugggggaaugggggugug

SEQ ID NO: 543 - RNA, 19 nt, Artificial Sequence
  source: /note="Description of Artificial Sequence: Synthetic oligonucleotide"
acugaagcuuuaucuggag

SEQ ID NO: 544 - RNA, 19 nt, Artificial Sequence
  source: /note="Description of Artificial Sequence: Synthetic oligonucleotide"
uuuuuuuuuugagauauaa

SEQ ID NO: 545 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacuccuccccauccucutt

SEQ ID NO: 546 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugucccucugucccucutt

SEQ ID NO: 547 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagcaccaugggacccacatt

SEQ ID NO: 548 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccucaggucccagccugcutt

SEQ ID NO: 549 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccagccugcugcuccugcutt

SEQ ID NO: 550 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacuaacccaccucccccutt

SEQ ID NO: 551 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacucuaucaucacccccatt

SEQ ID NO: 552 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caacaucuugcggcuggaatt

SEQ ID NO: 553 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagcgaggagaccauggutt

SEQ ID NO: 554 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccagucacuguuacugutt

SEQ ID NO: 555 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucccaggcaaaaaacuaatt

SEQ ID NO: 556 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agugcuguccagugagaaatt

SEQ ID NO: 557 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agacugugcugaccccugatt

SEQ ID NO: 558 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagggaguucaagucagaatt

SEQ ID NO: 559 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucaagucagaaaaggggatt

SEQ ID NO: 560 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucgugaccgugcaggccatt

SEQ ID NO: 561 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caggccaccuucgggaccatt

SEQ ID NO: 562 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caagugguggagaaggugatt

SEQ ID NO: 563 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugcuggucagccugcagatt

SEQ ID NO: 564 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcggguaccucuucaucatt

SEQ ID NO: 565 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagacagacaagaccaucutt

SEQ ID NO: 566 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuacaccccuggcuccacatt

SEQ ID NO: 567 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaguucucuaucggaucutt

SEQ ID NO: 568 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucaccgucaaccacaagatt

SEQ ID NO: 569 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggacggucauggucaacautt

SEQ ID NO: 570 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugagaacccggaaggcautt

SEQ ID NO: 571 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucccggucaagcaggacutt

SEQ ID NO: 572 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuccuugucuucucagaaatt

SEQ ID NO: 573 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugucuucucagaaccagatt

SEQ ID NO: 574 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuuggcgucuugcccuuatt

SEQ ID NO: 575 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcccuugucuugggacautt

SEQ ID NO: 576 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augggccaguggaagaucatt

SEQ ID NO: 577 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccaguggaagauccgagatt

SEQ ID NO: 578 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuacuaugaaaacucacatt

SEQ ID NO: 579 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacugaguuugaggugaaatt

SEQ ID NO: 580 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuugaggugaaggaguacatt

SEQ ID NO: 581 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgugcugcccaguuucgaatt

SEQ ID NO: 582 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggucauaguggagccuaatt

SEQ ID NO: 583 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagagaaauucuacuacautt

SEQ ID NO: 584 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuauaacgagaagggccutt

SEQ ID NO: 585 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuggaggucaccaucaccatt

SEQ ID NO: 586 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccagguuccucuacgggatt

SEQ ID NO: 587 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagaaaguggagggaacuatt

SEQ ID NO: 588 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaacugccuuugucaucutt

SEQ ID NO: 589 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucgggauccaggauggcatt

SEQ ID NO: 590 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgaacagaggauuucccuatt

SEQ ID NO: 591 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuucccugccugaaucccutt

SEQ ID NO: 592 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucaagcgcauuccgauuatt

SEQ ID NO: 593 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaggauggcucgggggaatt

SEQ ID NO: 594 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agguugugcugagccggaatt

SEQ ID NO: 595 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcugagccggaagguacutt

SEQ ID NO: 596 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gguacugcuggacgggguatt

SEQ ID NO: 597 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcagaacccccgagcagaatt

SEQ ID NO: 598 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacgugucugccaccgucatt

SEQ ID NO: 599 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugcacucaggcagugacatt

SEQ ID NO: 600 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcagagcgcagcgggautt

SEQ ID NO: 601 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucaccaagacacccaagutt

SEQ ID NO: 602 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accaagacacccaaguacutt

SEQ ID NO: 603 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucaaaccaggaaugcccutt

SEQ ID NO: 604 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgugacgaacccugaugatt

SEQ ID NO: 605 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccagggcgaggacacugutt

SEQ ID NO: 606 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaggacacugugcagucuatt

SEQ ID NO: 607 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuaacccagggagauggcatt

SEQ ID NO: 608 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cguggccaaacucagcauatt

SEQ ID NO: 609 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaacacacaccccagccatt

SEQ ID NO: 610 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagaagcccuugagcaucatt

SEQ ID NO: 611 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugagcaucacggugcgcatt

SEQ ID NO: 612 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagcucucggaggcagagatt

SEQ ID NO: 613 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caggcuaccaggaccaugatt

SEQ ID NO: 614 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcaggcucugcccuacagatt

SEQ ID NO: 615 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacagcaccgugggcaacutt

SEQ ID NO: 616 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuccaacaauuaccugcautt

SEQ ID NO: 617 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagugcuacguacagagcutt

SEQ ID NO: 618 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagacccggggagacccutt

SEQ ID NO: 619 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcgcccacgaggccaagautt

SEQ ID NO: 620 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccgcuacuacaccuaccutt

SEQ ID NO: 621 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugaucaugaacaagggcatt

SEQ ID NO: 622 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caggcuguugaaggcgggatt

SEQ ID NO: 623 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacgccaggugcgagagcatt

SEQ ID NO: 624 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccggccaggaccuggugatt

SEQ ID NO: 625 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccgccugguggcguacutt

SEQ ID NO: 626 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuacacgcugaucggugcatt

SEQ ID NO: 627 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggguggacgucaaggacutt

SEQ ID NO: 628 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccugcgugggcucgcuggutt

SEQ ID NO: 629 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugguaaaaagcggccaguatt

SEQ ID NO: 630 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagaagaccggcagccugutt

SEQ ID NO: 631 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccugggcagcagaugaccatt

SEQ ID NO: 632 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugaagauagagggugacatt

SEQ ID NO: 633 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccacggggcccgggugguatt

SEQ ID NO: 634 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acugguggccguggacaaatt

SEQ ID NO: 635 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaagaagaacaaacugacatt

SEQ ID NO: 636 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcagaguaagaucugggatt

SEQ ID NO: 637 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacgugguggagaaggcaatt

SEQ ID NO: 638 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accccgggcagugggaagatt

SEQ ID NO: 639 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauuacgccggugucuucutt

SEQ ID NO: 640 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccgacgcagggcugaccutt

SEQ ID NO: 641 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucacgagcagcaguggcatt

SEQ ID NO: 642 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccagcagaccgcccagagatt

SEQ ID NO: 643 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgcccagagggcagaacutt

SEQ ID NO: 644 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucagugcccgcagccagatt

SEQ ID NO: 645 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccgcccgccgacgccguutt

SEQ ID NO: 646 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acggagaagcgaauggacatt

SEQ ID NO: 647 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagucggcaaguaccccatt

SEQ ID NO: 648 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaggagcugcgcaagugatt

SEQ ID NO: 649 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcugcgaggacggcaugcatt

SEQ ID NO: 650 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaugagguucucgugccatt

SEQ ID NO: 651 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucucgugccagcgccggatt

SEQ ID NO: 652 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cguuucaucucccugggcatt

SEQ ID NO: 653 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaggcgugcaagaaggucutt

SEQ ID NO: 654 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccuggacugcugcaacutt

SEQ ID NO: 655 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuacaucacagagcugcgatt

SEQ ID NO: 656 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgcgcgggccagccaccutt

SEQ ID NO: 657 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugggccuggccaggaguaatt

SEQ ID NO: 658 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accuggaugaggacaucautt

SEQ ID NO: 659 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugcagaagagaacaucgutt

SEQ ID NO: 660 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuucccgaagugaguucatt

SEQ ID NO: 661 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucccagagagcuggcugutt

SEQ ID NO: 662 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guggaacguugaggacuuatt

SEQ ID NO: 663 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugaggacuugaaagagcatt

SEQ ID NO: 664 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggacuugaaagagccacatt

SEQ ID NO: 665 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgaaaaauggaaucucuaatt

SEQ ID NO: 666 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucuacgaagcucaugaautt

SEQ ID NO: 667 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauauuuuugaaagacucatt

SEQ ID NO: 668 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaucaccacgugggagautt

SEQ ID NO: 669 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auucuggcugugagcaugutt

SEQ ID NO: 670 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucggacaagaaagggaucutt

SEQ ID NO: 671 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcagaccccuucgaggucatt

SEQ ID NO: 672 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucaucgaccugcggcuaatt

SEQ ID NO: 673 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acccuacucuguuguucgatt

SEQ ID NO: 674 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuguuguucgaaacgagcatt

SEQ ID NO: 675 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagguggaaauccgagccatt

SEQ ID NO: 676 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cguucucuacaauuaccgatt

SEQ ID NO: 677 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagagcucaaggugagggutt

SEQ ID NO: 678 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guggaacuacuccacaauatt

SEQ ID NO: 679 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacuccacaauccagccuutt

SEQ ID NO: 680 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucugcagccuggccaccatt

SEQ ID NO: 681 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caccaagaggcgucaccaatt

SEQ ID NO: 682 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcagaccguaaccauccatt

SEQ ID NO: 683 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccucguuguccguuccautt

SEQ ID NO: 684 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaugucaucgugccgcuaatt

SEQ ID NO: 685 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaccggccugcaggaagutt

SEQ ID NO: 686 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guggaagucaaggcugcuatt

SEQ ID NO: 687 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucaucagugacggugucatt

SEQ ID NO: 688 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caggaagucccugaagguatt

SEQ ID NO: 689 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaucagaaugaacaaaacutt

SEQ ID NO: 690 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuguggcuguucgcacccutt

SEQ ID NO: 691 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuggauccagaacgccugatt

SEQ ID NO: 692 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaggagugcagaaagaggatt

SEQ ID NO: 693 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugaccaagucccggacaatt

SEQ ID NO: 694 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgagucugagaccagaautt

SEQ ID NO: 695 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuccugcaagggacccatt

SEQ ID NO: 696 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaguggcccagaugacaatt

SEQ ID NO: 697 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgucgacgcggaacggcuatt

SEQ ID NO: 698 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggggaacagaacaugauatt

SEQ ID NO: 699 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucggcaugacgcccacggutt

SEQ ID NO: 700 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaccuggaugaaacggagatt

SEQ ID NO: 701 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggaugaaacggagcaguatt

SEQ ID NO: 702 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggagaaguucggccuagatt

SEQ ID NO: 703 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaagcggcagggggccuutt

SEQ ID NO: 704 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggagcucaucaagaagatt

SEQ ID NO: 705 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagcucaucaagaaggggutt

SEQ ID NO: 706 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacacccagcagcuggccutt

SEQ ID NO: 707 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucagacaacccagcucutt

SEQ ID NO: 708 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcucugccuuugcggccutt

SEQ ID NO: 709 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucgugaaacgggcacccatt

SEQ ID NO: 710 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagcaccuggcugaccgcatt

SEQ ID NO: 711 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacguggucaaggucuucutt

SEQ ID NO: 712 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucucuggcugucaaccuatt

SEQ ID NO: 713 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggcugauccuggagaagatt

SEQ ID NO: 714 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagaagcccgacggggucutt

SEQ ID NO: 715 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucuuccaggaggaugcgatt

SEQ ID NO: 716 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccgugauacaccaagaaatt

SEQ ID NO: 717 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augauugguggauuacggatt

SEQ ID NO: 718 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacaacaacgagaaagacatt

SEQ ID NO: 719 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuguucucaucucgcugatt

SEQ ID NO: 720 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caggaggcuaaagauauuutt

SEQ ID NO: 721 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugcgaggagcaggucaaatt

SEQ ID NO: 722 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acagccugccaggcagcautt

SEQ ID NO: 723 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccugccaggcagcaucaatt

SEQ ID NO: 724 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuaaagcaggagacuuccutt

SEQ ID NO: 725 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuugaagccaacuacaugatt

SEQ ID NO: 726 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacaugaaccuacagagautt

SEQ ID NO: 727 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auccuacacuguggccauutt

SEQ ID NO: 728 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugcuggcuaugcucuggatt

SEQ ID NO: 729 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaggggccucuucuuaaatt

SEQ ID NO: 730 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaauuucugaccacagcatt

SEQ ID NO: 731 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaagauaagaaccgcugatt

SEQ ID NO: 732 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggaggacccugguaagcatt

SEQ ID NO: 733 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacccugguaagcagcucutt

SEQ ID NO: 734 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacaacguggaggccacautt

SEQ ID NO: 735 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuaugcccucuuggcccutt

SEQ ID NO: 736 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacugcagcuaaaagacuutt

SEQ ID NO: 737 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgucgugcguuggcucaautt

SEQ ID NO: 738 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaugaacagagauacuaatt

SEQ ID NO: 739 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acggugguggcuauggcuatt

SEQ ID NO: 740 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuacccaggccaccuucatt

SEQ ID NO: 741 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucaugguguuccaagccutt

SEQ ID NO: 742 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuggcucaauaccaaaagtt

SEQ ID NO: 743 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggacgccccugaccaccatt

SEQ ID NO: 744 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caggaacugaaccuugauatt

SEQ ID NO: 745 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugaugugucccuccaacutt

SEQ ID NO: 746 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcccagccgcagcuccatt

SEQ ID NO: 747 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcagcuccaagaucaccatt

SEQ ID NO: 748 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaccguauccacugggaatt

SEQ ID NO: 749 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccguauccacugggaaucutt

SEQ ID NO: 750 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccagccuccugcgaucatt

SEQ ID NO: 751 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaagagaccaaggaaaautt

SEQ ID NO: 752 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augaggguuucacagucaatt

SEQ ID NO: 753 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acagcugaaggaaaaggcatt

SEQ ID NO: 754 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaaggcaccuugucgguatt

SEQ ID NO: 755 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugucgguggugacaaugutt

SEQ ID NO: 756 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guaccaugcuaaggccaaatt

SEQ ID NO: 757 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuaaggccaaagaucaacutt

SEQ ID NO: 758 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caacucaccuguaauaaautt

SEQ ID NO: 759 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucgaccucaaggucaccatt

SEQ ID NO: 760 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaccauaaaaccagcacatt

SEQ ID NO: 761 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggaaacagaaaagaggcatt

SEQ ID NO: 762 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaggaugccaagaacacutt

SEQ ID NO: 763 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaugauccuugagaucugutt

SEQ ID NO: 764 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccagguaccggggagaccatt

SEQ ID NO: 765 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caggaugccacuaugucuatt

SEQ ID NO: 766 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuugcuccagacacagautt

SEQ ID NO: 767 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augaccugaagcagcuggatt

SEQ ID NO: 768 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugacagauacaucuccaatt

SEQ ID NO: 769 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaguaugagcuggacaaagtt

SEQ ID NO: 770 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaugagcuggacaaagccutt

SEQ ID NO: 771 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucuccgauaggaacacatt

SEQ ID NO: 772 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccucaucaucuaccuggatt

SEQ ID NO: 773 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacaaggucucacacucuatt

SEQ ID NO: 774 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacacucugaggaugacutt

SEQ ID NO: 775 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaggaugacugucuagcuutt

SEQ ID NO: 776 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucaaaguucaccaauacutt

SEQ ID NO: 777 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuaauguagagcuuauatt

SEQ ID NO: 778 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucaaggucuacgccuauutt

SEQ ID NO: 779 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacaaccuggaggaaagcutt

SEQ ID NO: 780 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuguacccgguucuaccautt

SEQ ID NO: 781 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auccggaaaaggaggaugatt

SEQ ID NO: 782 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaaggaggauggaaagcutt

SEQ ID NO: 783 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugaacaagcucugccguatt

SEQ ID NO: 784 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaugaacugugccgcugutt

SEQ ID NO: 785 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugcugaggagaauugcuutt

SEQ ID NO: 786 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauugcuucauacaaaagutt

SEQ ID NO: 787 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucggaugacaaggucacatt

SEQ ID NO: 788 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccuggaagaacggcuggatt

SEQ ID NO: 789 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacaaggccugugagccaatt

SEQ ID NO: 790 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggccugugagccaggagutt

SEQ ID NO: 791 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaggaguggacuaugugutt

SEQ ID NO: 792 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacaagacccgacuggucatt

SEQ ID NO: 793 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucagcuguccaaugacuutt

SEQ ID NO: 794 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuugacgaguacaucaugatt

SEQ ID NO: 795 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacaucauggccauugagatt

SEQ ID NO: 796 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagaccaucaagucaggcutt

SEQ ID NO: 797 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucggaugaggugcagguutt

SEQ ID NO: 798 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucaucagccccaucaagutt

SEQ ID NO: 799 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaagugcagagaagcccutt

SEQ ID NO: 800 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugaagcuggaggagaagatt

SEQ ID NO: 801 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagcuggaggagaagaaactt

SEQ ID NO: 802 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acacuaccucauguggggutt

SEQ ID NO: 803 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuggggagagaagcccatt

SEQ ID NO: 804 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacaucaucgggaaggacatt

SEQ ID NO: 805 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacuuggguggagcacugatt

SEQ ID NO: 806 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggacgaaugccaagacgatt

SEQ ID NO: 807 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagagaaccagaaacaauatt

SEQ ID NO: 808 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccaggaccucggcgccutt

SEQ ID NO: 809 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucaccgagagcaugguutt

SEQ ID NO: 810 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacacccccauucccccaatt

SEQ ID NO: 811 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuccagauaaagcuucagutt

SEQ ID NO: 812 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuauaucucaaaaaaaaaatt

SEQ ID NO: 813 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaggauggggaggagugatt

SEQ ID NO: 814 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagggacagagggacagatt

SEQ ID NO: 815 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugggucccauggugcugtt

SEQ ID NO: 816 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcaggcugggaccugaggtt

SEQ ID NO: 817 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcaggagcagcaggcuggtt

SEQ ID NO: 818 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggggagguggguuaguatt

SEQ ID NO: 819 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugggggugaugauagaguatt

SEQ ID NO: 820 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccagccgcaagauguugtt

SEQ ID NO: 821 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accauggucuccucgcucutt

SEQ ID NO: 822 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaguaacagugacuggaatt

SEQ ID NO: 823 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaguuuuuugccugggaatt

SEQ ID NO: 824 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuucucacuggacagcacutt

SEQ ID NO: 825 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaggggucagcacagucutt

SEQ ID NO: 826 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucugacuugaacucccugtt

SEQ ID NO: 827 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccccuuuucugacuugaatt

SEQ ID NO: 828 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggccugcacggucacgaatt

SEQ ID NO: 829 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggucccgaagguggccugtt

SEQ ID NO: 830 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaccuucuccaccacuugtt

SEQ ID NO: 831 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugcaggcugaccagcactt

SEQ ID NO: 832 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaugaagagguacccgcutt

SEQ ID NO: 833 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agauggucuugucugucugtt

SEQ ID NO: 834 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguggagccagggguguagtt

SEQ ID NO: 835 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agauccgauagagaacugutt

SEQ ID NO: 836 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuugugguugacggugaatt

SEQ ID NO: 837 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auguugaccaugaccgucctt

SEQ ID NO: 838 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augccuuccggguucucaatt

SEQ ID NO: 839 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguccugcuugaccgggautt

SEQ ID NO: 840 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuucugagaagacaaggagtt

SEQ ID NO: 841 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugguucugagaagacaatt

SEQ ID NO: 842 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaagggcaagacgccaagctt

SEQ ID NO: 843 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augucccaagacaagggcatt

SEQ ID NO: 844 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaucuuccacuggcccautt

SEQ ID NO: 845 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucggaucuuccacuggctt

SEQ ID NO: 846 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugaguuuucauaguaggtt

SEQ ID NO: 847 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuucaccucaaacucagugtt

SEQ ID NO: 848 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguacuccuucaccucaaatt

SEQ ID NO: 849 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucgaaacugggcagcacgtt

SEQ ID NO: 850 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaggcuccacuaugaccutt

SEQ ID NO: 851 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auguaguagaauuucucugtt

SEQ ID NO: 852 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcccuucucguuauagatt

SEQ ID NO: 853 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggugauggugaccuccagtt

SEQ ID NO: 854 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccguagaggaaccuggctt

SEQ ID NO: 855 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaguucccuccacuuucuutt

SEQ ID NO: 856 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaugacaaaggcaguucctt

SEQ ID NO: 857 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccauccuggaucccgaatt

SEQ ID NO: 858 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagggaaauccucuguucgtt

SEQ ID NO: 859 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggauucaggcagggaaatt

SEQ ID NO: 860 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaucggaaugcgcuugagtt

SEQ ID NO: 861 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucccccgagccauccucatt

SEQ ID NO: 862 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccggcucagcacaaccutt

SEQ ID NO: 863 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguaccuuccggcucagcatt

SEQ ID NO: 864 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaccccguccagcaguacctt

SEQ ID NO: 865 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucugcucggggguucugctt

SEQ ID NO: 866 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugacgguggcagacacguatt

SEQ ID NO: 867 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucacugccugagugcaatt

SEQ ID NO: 868 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucccgcugcgcucugccutt

SEQ ID NO: 869 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuugggugucuuggugaatt

SEQ ID NO: 870 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguacuugggugucuuggutt

SEQ ID NO: 871 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggcauuccugguuugaatt

SEQ ID NO: 872 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaucaggguucgucacgatt

SEQ ID NO: 873 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaguguccucgcccuggatt

SEQ ID NO: 874 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagacugcacaguguccuctt

SEQ ID NO: 875 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccaucucccuggguuagtt

SEQ ID NO: 876 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaugcugaguuuggccacgtt

SEQ ID NO: 877 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggcugggguguguguugatt

SEQ ID NO: 878 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaugcucaagggcuucugtt

SEQ ID NO: 879 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcgcaccgugaugcucaatt

SEQ ID NO: 880 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucugccuccgagagcuctt

SEQ ID NO: 881 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaugguccugguagccugtt

SEQ ID NO: 882 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuguagggcagagccugctt

SEQ ID NO: 883 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguugcccacggugcuguatt

SEQ ID NO: 884 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augcagguaauuguuggagtt

SEQ ID NO: 885 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcucuguacguagcacugtt

SEQ ID NO: 886 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggucuccccgggucugatt

SEQ ID NO: 887 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucuuggccucgugggcgctt

SEQ ID NO: 888 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agguagguguaguagcggatt

SEQ ID NO: 889 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcccuuguucaugaucagtt

SEQ ID NO: 890 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccgccuucaacagccugtt

SEQ ID NO: 891 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcucucgcaccuggcguctt

SEQ ID NO: 892 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaccagguccuggccgggtt

SEQ ID NO: 893 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguacgccaccaggcggaatt

SEQ ID NO: 894 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcaccgaucagcguguagtt

SEQ ID NO: 895 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguccuugacguccacccatt

SEQ ID NO: 896 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accagcgagcccacgcaggtt

SEQ ID NO: 897 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacuggccgcuuuuuaccatt

SEQ ID NO: 898 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaggcugccggucuucugtt

SEQ ID NO: 899 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggucaucugcugcccaggtt

SEQ ID NO: 900 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucacccucuaucuucagtt

SEQ ID NO: 901 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaccacccgggccccguggtt

SEQ ID NO: 902 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuguccacggccaccagutt

SEQ ID NO: 903 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucaguuuguucuucuuatt

SEQ ID NO: 904 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccagaucuuacucugcgtt

SEQ ID NO: 905 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugccuucuccaccacguctt

SEQ ID NO: 906 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuucccacugcccggggutt

SEQ ID NO: 907 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaagacaccggcguaauctt

SEQ ID NO: 908 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggucagcccugcgucggatt

SEQ ID NO: 909 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccacugcugcucgugaatt

SEQ ID NO: 910 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucugggcggucugcuggtt

SEQ ID NO: 911 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguucugcccucugggcggtt

SEQ ID NO: 912 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuggcugcgggcacugaatt

SEQ ID NO: 913 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacggcgucggcgggcggctt

SEQ ID NO: 914 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguccauucgcuucuccgutt

SEQ ID NO: 915 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugggguacuugccgacuuutt

SEQ ID NO: 916 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacuugcgcagcuccuugtt

SEQ ID NO: 917 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcaugccguccucgcagctt

SEQ ID NO: 918 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggcacgagaaccucauggtt

SEQ ID NO: 919 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccggcgcuggcacgagaatt

SEQ ID NO: 920 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcccagggagaugaaacgtt

SEQ ID NO: 921 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaccuucuugcacgccuctt

SEQ ID NO: 922 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguugcagcaguccaggaatt

SEQ ID NO: 923 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgcagcucugugauguagtt

SEQ ID NO: 924 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agguggcuggcccgcgcgutt

SEQ ID NO: 925 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuacuccuggccaggcccatt

SEQ ID NO: 926 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augauguccucauccaggutt

SEQ ID NO: 927 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgauguucucuucugcaatt

SEQ ID NO: 928 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaacucacuucgggaaactt

SEQ ID NO: 929 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acagccagcucucugggaatt

SEQ ID NO: 930 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaguccucaacguuccactt

SEQ ID NO: 931 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcucuuucaaguccucaatt

SEQ ID NO: 932 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguggcucuuucaaguccutt

SEQ ID NO: 933 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuagagauuccauuuuucgtt

SEQ ID NO: 934 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auucaugagcuucguagagtt

SEQ ID NO: 935 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagucuuucaaaaauauatt

SEQ ID NO: 936 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucucccacguggugauggtt

SEQ ID NO: 937 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaugcucacagccagaautt

SEQ ID NO: 938 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaucccuuucuuguccgatt

SEQ ID NO: 939 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaccucgaaggggucugctt

SEQ ID NO: 940 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuagccgcaggucgaugaatt

SEQ ID NO: 941 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgaacaacagaguagggutt

SEQ ID NO: 942 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcucguuucgaacaacagtt

SEQ ID NO: 943 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggcucggauuuccaccugtt

SEQ ID NO: 944 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgguaauuguagagaacgtt

SEQ ID NO: 945 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acccucaccuugagcucuutt

SEQ ID NO: 946 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauuguggaguaguuccactt

SEQ ID NO: 947 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaggcuggauuguggaguatt

SEQ ID NO: 948 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugguggccaggcugcagaatt

SEQ ID NO: 949 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggugacgccucuuggugtt

SEQ ID NO: 950 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggaugguuacggucugcutt

SEQ ID NO: 951 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auggaacggacaacgaggatt

SEQ ID NO: 952 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuagcggcacgaugacauatt

SEQ ID NO: 953 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuuccugcaggccggucutt

SEQ ID NO: 954 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagcagccuugacuuccactt

SEQ ID NO: 955 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugacaccgucacugaugaatt

SEQ ID NO: 956 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaccuucagggacuuccugtt

SEQ ID NO: 957 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguuuuguucauucugauutt

SEQ ID NO: 958 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggugcgaacagccacagtt

SEQ ID NO: 959 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaggcguucuggauccagtt

SEQ ID NO: 960 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccucuuucugcacuccuutt

SEQ ID NO: 961 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuguccgggacuuggucactt

SEQ ID NO: 962 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auucuggucucagacucggtt

SEQ ID NO: 963 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugggucccuugcaggagaatt

SEQ ID NO: 964 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugucaucugggccacuggtt

SEQ ID NO: 965 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagccguuccgcgucgacgtt

SEQ ID NO: 966 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaucauguucuguuccccgtt

SEQ ID NO: 967 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accgugggcgucaugccgatt

SEQ ID NO: 968 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuccguuucauccagguatt

SEQ ID NO: 969 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacugcuccguuucauccatt

SEQ ID NO: 970 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuaggccgaacuucuccctt

SEQ ID NO: 971 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaggcccccugccgcuucutt

SEQ ID NO: 972 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuucuugaugagcuccaatt

SEQ ID NO: 973 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accccuucuugaugagcuctt

SEQ ID NO: 974 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggccagcugcuggguguatt

SEQ ID NO: 975 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagcuggguugucugaagtt

SEQ ID NO: 976 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggccgcaaaggcagagcutt

SEQ ID NO: 977 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugggugcccguuucacgaatt

SEQ ID NO: 978 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcggucagccaggugcugtt

SEQ ID NO: 979 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaagaccuugaccacguatt

SEQ ID NO: 980 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagguugacagccagagagtt

SEQ ID NO: 981 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuucuccaggaucagccatt

SEQ ID NO: 982 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaccccgucgggcuucugtt

SEQ ID NO: 983 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgcauccuccuggaagactt

SEQ ID NO: 984 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuucuugguguaucacgggtt

SEQ ID NO: 985 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccguaauccaccaaucautt

SEQ ID NO: 986 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucuuucucguuguuguutt

SEQ ID NO: 987 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagcgagaugagaacaaatt

SEQ ID NO: 988 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaauaucuuuagccuccugtt

SEQ ID NO: 989 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuugaccugcuccucgcaatt

SEQ ID NO: 990 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augcugccuggcaggcugutt

SEQ ID NO: 991 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugaugcugccuggcaggctt

SEQ ID NO: 992 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggaagucuccugcuuuagtt

SEQ ID NO: 993 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucauguaguuggcuucaagtt

SEQ ID NO: 994 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucucuguagguucauguatt

SEQ ID NO: 995 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauggccacaguguaggautt

SEQ ID NO: 996 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccagagcauagccagcaatt

SEQ ID NO: 997 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuaagaagaggccccuuctt

SEQ ID NO: 998 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuguggucagaaauuugtt

SEQ ID NO: 999 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagcgguucuuaucuuugtt

SEQ ID NO: 1000 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuuaccaggguccuccctt

SEQ ID NO: 1001 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagcugcuuaccaggguctt

SEQ ID NO: 1002 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auguggccuccacguuguatt

SEQ ID NO: 1003 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggccaagagggcauaggtt

SEQ ID NO: 1004 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagucuuuuagcugcaguatt

SEQ ID NO: 1005 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auugagccaacgcacgacgtt

SEQ ID NO: 1006 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaguaucucuguucauugtt

SEQ ID NO: 1007 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagccauagccaccaccgutt

SEQ ID NO: 1008 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaagguggccuggguagatt

SEQ ID NO: 1009 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcuuggaacaccaugaatt

SEQ ID NO: 1010 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuugguauugagccaagtt

SEQ ID NO: 1011 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugguggucaggggcguccutt

SEQ ID NO: 1012 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaucaagguucaguuccugtt

SEQ ID NO: 1013 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguuggagggacacaucaatt

SEQ ID NO: 1014 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggagcugcggcugggcagtt

SEQ ID NO: 1015 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggugaucuuggagcugcgtt

SEQ ID NO: 1016 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucccaguggauacgguggtt

SEQ ID NO: 1017 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agauucccaguggauacggtt

SEQ ID NO: 1018 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaucgcaggaggcuggcatt

SEQ ID NO: 1019 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuuuccuuggucucuucutt

SEQ ID NO: 1020 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugacugugaaacccucautt

SEQ ID NO: 1021 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccuuuuccuucagcugutt

SEQ ID NO: 1022 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaccgacaaggugccuuggtt

SEQ ID NO: 1023 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acauugucaccaccgacaatt

SEQ ID NO: 1024 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuggccuuagcaugguactt

SEQ ID NO: 1025 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguugaucuuuggccuuagtt

SEQ ID NO: 1026 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuuauuacaggugaguugtt

SEQ ID NO: 1027 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggugaccuugaggucgaatt

SEQ ID NO: 1028 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugcugguuuuauggugatt

SEQ ID NO: 1029 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccucuuuucuguuuccgtt

SEQ ID NO: 1030 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguguucuuggcauccugatt

SEQ ID NO: 1031 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acagaucucaaggaucauatt

SEQ ID NO: 1032 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggucuccccgguaccuggtt

SEQ ID NO: 1033 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagacauaguggcauccugtt

SEQ ID NO: 1034 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucugugucuggagcaaagtt

SEQ ID NO: 1035 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccagcugcuucaggucautt

SEQ ID NO: 1036 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggagauguaucugucaatt

SEQ ID NO: 1037 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuguccagcucauacuutt

SEQ ID NO: 1038 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcuuuguccagcucauatt

SEQ ID NO: 1039 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguguuccuaucggagaagtt

SEQ ID NO: 1040 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccagguagaugaugagggtt

SEQ ID NO: 1041 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagagugugagaccuuguctt

SEQ ID NO: 1042 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agucauccucagagugugatt

SEQ ID NO: 1043 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagcuagacagucauccuctt

SEQ ID NO: 1044 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguauuggugaacuuugaatt

SEQ ID NO: 1045 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauaagcucuacauuaaagtt

SEQ ID NO: 1046 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauaggcguagaccuugactt

SEQ ID NO: 1047 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcuuuccuccagguuguatt

SEQ ID NO: 1048 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augguagaaccggguacagtt

SEQ ID NO: 1049 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucauccuccuuuuccggautt

SEQ ID NO: 1050 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcuuuccauccuccuuuutt

SEQ ID NO: 1051 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacggcagagcuuguucagtt

SEQ ID NO: 1052 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acagcggcacaguucaucatt

SEQ ID NO: 1053 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagcaauucuccucagcactt

SEQ ID NO: 1054 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuuuuguaugaagcaauutt

SEQ ID NO: 1055 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugaccuugucauccgactt

SEQ ID NO: 1056 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccagccguucuuccagggtt

SEQ ID NO: 1057 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggcucacaggccuuguctt

SEQ ID NO: 1058 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuccuggcucacaggccutt

SEQ ID NO: 1059 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acacauaguccacuccuggtt

SEQ ID NO: 1060 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaccagucgggucuuguatt

SEQ ID NO: 1061 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagucauuggacagcugaatt

SEQ ID NO: 1062 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaugauguacucgucaaatt

SEQ ID NO: 1063 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucaauggccaugauguatt

SEQ ID NO: 1064 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agccugacuugauggucugtt

SEQ ID NO: 1065 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaccugcaccucauccgagtt

SEQ ID NO: 1066 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuugauggggcugaugaatt

SEQ ID NO: 1067 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggcuucucugcacuugatt

SEQ ID NO: 1068 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuucuccuccagcuucagtt

SEQ ID NO: 1069 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuucuucuccuccagcuutt

SEQ ID NO: 1070 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accccacaugagguagugutt

SEQ ID NO: 1071 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugggcuucucuccccagaatt

SEQ ID NO: 1072 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguccuucccgaugauguatt

SEQ ID NO: 1073 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagugcuccacccaagugtt

SEQ ID NO: 1074 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgucuuggcauucguccutt

SEQ ID NO: 1075 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauuguuucugguucucuutt

SEQ ID NO: 1076 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcgccgagguccuggcatt

SEQ ID NO: 1077 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaccaugcucucggugaagtt

SEQ ID NO: 1078 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugggggaaugggggugugtt

SEQ ID NO: 1079 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acugaagcuuuaucuggagtt

SEQ ID NO: 1080 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuuuuuuugagauauaatt

SEQ ID NO: 1081 - RNA, 19 nt, Artificial Sequence
  source: /note="Description of Artificial Sequence: Synthetic oligonucleotide"
ucacuccuccccauccucu

SEQ ID NO: 1082 - RNA, 19 nt, Artificial Sequence
  source: /note="Description of Artificial Sequence: Synthetic oligonucleotide"
ucugucccucugucccucu

SEQ ID NO: 1083 - RNA, 19 nt, Artificial Sequence
  source: /note="Description of Artificial Sequence: Synthetic oligonucleotide"
cagcaccaugggacccacc

SEQ ID NO: 1084 - RNA, 19 nt, Artificial Sequence
  source: /note="Description of Artificial Sequence: Synthetic oligonucleotide"
ccucaggucccagccugcu

SEQ ID NO: 1085 - RNA, 19 nt, Artificial Sequence
  source: /note="Description of Artificial Sequence: Synthetic oligonucleotide"
ccagccugcugcuccugcu

SEQ ID NO: 1086 - RNA, 19 nt, Artificial Sequence
  source: /note="Description of Artificial Sequence: Synthetic oligonucleotide"
uacuaacccaccucccccu

SEQ ID NO: 1087 - RNA, 19 nt, Artificial Sequence
  source: /note="Description of Artificial Sequence: Synthetic oligonucleotide"
uacucuaucaucaccccca

SEQ ID NO: 1088 - RNA, 19 nt, Artificial Sequence
  source: /note="Description of Artificial Sequence: Synthetic oligonucleotide"
caacaucuugcggcuggag

SEQ ID NO: 1089 - RNA, 19 nt, Artificial Sequence
  source: /note="Description of Artificial Sequence: Synthetic oligonucleotide"
agagcgaggagaccauggu

SEQ ID NO: 1090 - RNA, 19 nt, Artificial Sequence
  source: /note="Description of Artificial Sequence: Synthetic oligonucleotide"
uuccagucacuguuacugu

SEQ ID NO: 1091 - RNA, 19 nt, Artificial Sequence
  source: /note="Description of Artificial Sequence: Synthetic oligonucleotide"
uucccaggcaaaaaacuag

SEQ ID NO: 1092 - RNA, 19 nt, Artificial Sequence
  source: /note="Description of Artificial Sequence: Synthetic oligonucleotide"
agugcuguccagugagaag

SEQ ID NO: 1093 - RNA, 19 nt, Artificial Sequence
  source: /note="Description of Artificial Sequence: Synthetic oligonucleotide"
agacugugcugaccccugc

SEQ ID NO: 1094 - RNA, 19 nt, Artificial Sequence
  source: /note="Description of Artificial Sequence: Synthetic oligonucleotide"
cagggaguucaagucagaa

SEQ ID NO: 1095 - RNA, 19 nt, Artificial Sequence
  source: /note="Description of Artificial Sequence: Synthetic oligonucleotide"
uucaagucagaaaaggggc

SEQ ID NO: 1096 - RNA, 19 nt, Artificial Sequence
  source: /note="Description of Artificial Sequence: Synthetic oligonucleotide"
uucgugaccgugcaggcca

SEQ ID NO: 1097 - RNA, 19 nt, Artificial Sequence
  source: /note="Description of Artificial Sequence: Synthetic oligonucleotide"
caggccaccuucgggaccc

SEQ ID NO: 1098 - RNA, 19 nt, Artificial Sequence
  source: /note="Description of Artificial Sequence: Synthetic oligonucleotide"
caagugguggagaaggugg

SEQ ID NO: 1099 - RNA, 19 nt, Artificial Sequence
  source: /note="Description of Artificial Sequence: Synthetic oligonucleotide"
gugcuggucagccugcaga

SEQ ID NO: 1100 - RNA, 19 nt, Artificial Sequence
  source: /note="Description of Artificial Sequence: Synthetic oligonucleotide"
agcggguaccucuucaucc

SEQ ID NO: 1101 - RNA, 19 nt, Artificial Sequence
  source: /note="Description of Artificial Sequence: Synthetic oligonucleotide"
cagacagacaagaccaucu

SEQ ID NO: 1102 - RNA, 19 nt, Artificial Sequence
  source: /note="Description of Artificial Sequence: Synthetic oligonucleotide"
cuacaccccuggcuccaca

SEQ ID NO: 1103 - RNA, 19 nt, Artificial Sequence
  source: /note="Description of Artificial Sequence: Synthetic oligonucleotide"
acaguucucuaucggaucu

SEQ ID NO: 1104 - RNA, 19 nt, Artificial Sequence
  source: /note="Description of Artificial Sequence: Synthetic oligonucleotide"
uucaccgucaaccacaagc

SEQ ID NO: 1105 - RNA, 19 nt, Artificial Sequence
  source: /note="Description of Artificial Sequence: Synthetic oligonucleotide"
ggacggucauggucaacau

SEQ ID NO: 1106 - RNA, 19 nt, Artificial Sequence
  source: /note="Description of Artificial Sequence: Synthetic oligonucleotide"
uugagaacccggaaggcau

SEQ ID NO: 1107 - RNA, 19 nt, Artificial Sequence
  source: /note="Description of Artificial Sequence: Synthetic oligonucleotide"
aucccggucaagcaggacu

SEQ ID NO: 1108 - RNA, 19 nt, Artificial Sequence
  source: /note="Description of Artificial Sequence: Synthetic oligonucleotide"
cuccuugucuucucagaac

SEQ ID NO: 1109 - RNA, 19 nt, Artificial Sequence
  source: /note="Description of Artificial Sequence: Synthetic oligonucleotide"
uugucuucucagaaccagc

SEQ ID NO: 1110 - RNA, 19 nt, Artificial Sequence
  source: /note="Description of Artificial Sequence: Synthetic oligonucleotide"
gcuuggcgucuugcccuug

SEQ ID NO: 1111 - RNA, 19 nt, Artificial Sequence
  source: /note="Description of Artificial Sequence: Synthetic oligonucleotide"
ugcccuugucuugggacau

SEQ ID NO: 1112 - RNA, 19 nt, Artificial Sequence
  source: /note="Description of Artificial Sequence: Synthetic oligonucleotide"
augggccaguggaagaucc

SEQ ID NO: 1113 - RNA, 19 nt, Artificial Sequence
  source: /note="Description of Artificial Sequence: Synthetic oligonucleotide"
gccaguggaagauccgagc

SEQ ID NO: 1114 - RNA, 19 nt, Artificial Sequence
  source: /note="Description of Artificial Sequence: Synthetic oligonucleotide"
ccuacuaugaaaacucacc

SEQ ID NO: 1115 - RNA, 19 nt, Artificial Sequence
  source: /note="Description of Artificial Sequence: Synthetic oligonucleotide"
cacugaguuugaggugaag

SEQ ID NO: 1116 - RNA, 19 nt, Artificial Sequence
  source: /note="Description of Artificial Sequence: Synthetic oligonucleotide"
uuugaggugaaggaguacg

SEQ ID NO: 1117 - RNA, 19 nt, Artificial Sequence
  source: /note="Description of Artificial Sequence: Synthetic oligonucleotide"
cgugcugcccaguuucgag

SEQ ID NO: 1118 - RNA, 19 nt, Artificial Sequence
  source: /note="Description of Artificial Sequence: Synthetic oligonucleotide"
aggucauaguggagccuac

SEQ ID NO: 1119 - RNA, 19 nt, Artificial Sequence
  source: /note="Description of Artificial Sequence: Synthetic oligonucleotide"
cagagaaauucuacuacau

SEQ ID NO: 1120 - RNA, 19 nt, Artificial Sequence
  source: /note="Description of Artificial Sequence: Synthetic oligonucleotide"
ucuauaacgagaagggccu

SEQ ID NO: 1121 - RNA, 19 nt, Artificial Sequence
  source: /note="Description of Artificial Sequence: Synthetic oligonucleotide"
cuggaggucaccaucaccg

SEQ ID NO: 1122 - RNA, 19 nt, Artificial Sequence
  source: /note="Description of Artificial Sequence: Synthetic oligonucleotide"
gccagguuccucuacggga

SEQ ID NO: 1123 - RNA, 19 nt, Artificial Sequence
  source: /note="Description of Artificial Sequence: Synthetic oligonucleotide"
aagaaaguggagggaacug

SEQ ID NO: 1124 - RNA, 19 nt, Artificial Sequence
  source: /note="Description of Artificial Sequence: Synthetic oligonucleotide"
ggaacugccuuugucaucu

SEQ ID NO: 1125 - RNA, 19 nt, Artificial Sequence
  source: /note="Description of Artificial Sequence: Synthetic oligonucleotide"
uucgggauccaggauggcg

SEQ ID NO: 1126 - RNA, 19 nt, Artificial Sequence
  source: /note="Description of Artificial Sequence: Synthetic oligonucleotide"
cgaacagaggauuucccug

SEQ ID NO: 1127 - RNA, 19 nt, Artificial Sequence
  source: /note="Description of Artificial Sequence: Synthetic oligonucleotide"
uuucccugccugaaucccu

SEQ ID NO: 1128 - RNA, 19 nt, Artificial Sequence
  source: /note="Description of Artificial Sequence: Synthetic oligonucleotide"
cucaagcgcauuccgauug

SEQ ID NO: 1129 - RNA, 19 nt, Artificial Sequence
  source: /note="Description of Artificial Sequence: Synthetic oligonucleotide"
ugaggauggcucgggggag

SEQ ID NO: 1130 - RNA, 19 nt, Artificial Sequence
  source: /note="Description of Artificial Sequence: Synthetic oligonucleotide"
agguugugcugagccggaa

SEQ ID NO: 1131 - RNA, 19 nt, Artificial Sequence
  source: /note="Description of Artificial Sequence: Synthetic oligonucleotide"
ugcugagccggaagguacu

SEQ ID NO: 1132 - RNA, 19 nt, Artificial Sequence
  source: /note="Description of Artificial Sequence: Synthetic oligonucleotide"
gguacugcuggacggggug

SEQ ID NO: 1133 - RNA, 19 nt, Artificial Sequence
  source: /note="Description of Artificial Sequence: Synthetic oligonucleotide"
gcagaacccccgagcagaa

SEQ ID NO: 1134 - RNA, 19 nt, Artificial Sequence
  source: /note="Description of Artificial Sequence: Synthetic oligonucleotide"
uacgugucugccaccguca

SEQ ID NO: 1135 - RNA, 19 nt, Artificial Sequence
  source: /note="Description of Artificial Sequence: Synthetic oligonucleotide"
uugcacucaggcagugaca

SEQ ID NO: 1136 - RNA, 19 nt, Artificial Sequence
  source: /note="Description of Artificial Sequence: Synthetic oligonucleotide"
aggcagagcgcagcgggau

SEQ ID NO: 1137 - RNA, 19 nt, Artificial Sequence
  source: /note="Description of Artificial Sequence: Synthetic oligonucleotide"
uucaccaagacacccaagu

SEQ ID NO: 1138 - RNA, 19 nt, Artificial Sequence
  source: /note="Description of Artificial Sequence: Synthetic oligonucleotide"
accaagacacccaaguacu

SEQ ID NO: 1139 - RNA, 19 nt, Artificial Sequence
  source: /note="Description of Artificial Sequence: Synthetic oligonucleotide"
uucaaaccaggaaugcccu

SEQ ID NO: 1140 - RNA, 19 nt, Artificial Sequence
  source: /note="Description of Artificial Sequence: Synthetic oligonucleotide"
ucgugacgaacccugaugg

SEQ ID NO: 1141 - RNA, 19 nt, Artificial Sequence
  source: /note="Description of Artificial Sequence: Synthetic oligonucleotide"
uccagggcgaggacacugu

SEQ ID NO: 1142 - RNA, 19 nt, Artificial Sequence
  source: /note="Description of Artificial Sequence: Synthetic oligonucleotide"
gaggacacugugcagucuc

SEQ ID NO: 1143 - RNA, 19 nt, Artificial Sequence
  source: /note="Description of Artificial Sequence: Synthetic oligonucleotide"
cuaacccagggagauggcg

SEQ ID NO: 1144 - RNA, 19 nt, Artificial Sequence
  source: /note="Description of Artificial Sequence: Synthetic oligonucleotide"
cguggccaaacucagcauc

SEQ ID NO: 1145 - RNA, 19 nt, Artificial Sequence
  source: /note="Description of Artificial Sequence: Synthetic oligonucleotide"
ucaacacacaccccagcca

SEQ ID NO: 1146 - RNA, 19 nt, Artificial Sequence
  source: /note="Description of Artificial Sequence: Synthetic oligonucleotide"
cagaagcccuugagcauca

SEQ ID NO: 1147 - RNA, 19 nt, Artificial Sequence
  source: /note="Description of Artificial Sequence: Synthetic oligonucleotide"
uugagcaucacggugcgca

SEQ ID NO: 1148 - RNA, 19 nt, Artificial Sequence
  source: /note="Description of Artificial Sequence: Synthetic oligonucleotide"
gagcucucggaggcagagc

SEQ ID NO: 1149 - RNA, 19 nt, Artificial Sequence
  source: /note="Description of Artificial Sequence: Synthetic oligonucleotide"
caggcuaccaggaccaugc

SEQ ID NO: 1150 - RNA, 19 nt, Artificial Sequence
  source: /note="Description of Artificial Sequence: Synthetic oligonucleotide"
gcaggcucugcccuacagc

SEQ ID NO: 1151 - RNA, 19 nt, Artificial Sequence
  source: /note="Description of Artificial Sequence: Synthetic oligonucleotide"
uacagcaccgugggcaacu

SEQ ID NO: 1152 - RNA, 19 nt, Artificial Sequence
  source: /note="Description of Artificial Sequence: Synthetic oligonucleotide"
cuccaacaauuaccugcau

SEQ ID NO: 1153 - RNA, 19 nt, Artificial Sequence
  source: /note="Description of Artificial Sequence: Synthetic oligonucleotide"
cagugcuacguacagagcu

SEQ ID NO: 1154 - RNA, 19 nt, Artificial Sequence
  source: /note="Description of Artificial Sequence: Synthetic oligonucleotide"
ucagacccggggagacccu

SEQ ID NO: 1155 - RNA, 19 nt, Artificial Sequence
  source: /note="Description of Artificial Sequence: Synthetic oligonucleotide"
gcgcccacgaggccaagau

SEQ ID NO: 1156 - RNA, 19 nt, Artificial Sequence
  source: /note="Description of Artificial Sequence: Synthetic oligonucleotide"
uccgcuacuacaccuaccu

SEQ ID NO: 1157 - RNA, 19 nt, Artificial Sequence
  source: /note="Description of Artificial Sequence: Synthetic oligonucleotide"
cugaucaugaacaagggca

SEQ ID NO: 1158 - RNA, 19 nt, Artificial Sequence
  source: /note="Description of Artificial Sequence: Synthetic oligonucleotide"
caggcuguugaaggcggga

SEQ ID NO: 1159 - RNA, 19 nt, Artificial Sequence
  source: /note="Description of Artificial Sequence: Synthetic oligonucleotide"
gacgccaggugcgagagcc

SEQ ID NO: 1160 - RNA, 19 nt, Artificial Sequence
  source: /note="Description of Artificial Sequence: Synthetic oligonucleotide"
cccggccaggaccuggugg

SEQ ID NO: 1161 - RNA, 19 nt, Artificial Sequence
  source: /note="Description of Artificial Sequence: Synthetic oligonucleotide"
uuccgccugguggcguacu

SEQ ID NO: 1162 - RNA, 19 nt, Artificial Sequence
  source: /note="Description of Artificial Sequence: Synthetic oligonucleotide"
cuacacgcugaucggugcc

SEQ ID NO: 1163 - RNA, 19 nt, Artificial Sequence
  source: /note="Description of Artificial Sequence: Synthetic oligonucleotide"
uggguggacgucaaggacu

SEQ ID NO: 1164 - RNA, 19 nt, Artificial Sequence
  source: /note="Description of Artificial Sequence: Synthetic oligonucleotide"
ccugcgugggcucgcuggu

SEQ ID NO: 1165 - RNA, 19 nt, Artificial Sequence
  source: /note="Description of Artificial Sequence: Synthetic oligonucleotide"
ugguaaaaagcggccaguc

SEQ ID NO: 1166 - RNA, 19 nt, Artificial Sequence
  source: /note="Description of Artificial Sequence: Synthetic oligonucleotide"
cagaagaccggcagccugu

SEQ ID NO: 1167 - RNA, 19 nt, Artificial Sequence
  source: /note="Description of Artificial Sequence: Synthetic oligonucleotide"
ccugggcagcagaugaccc

SEQ ID NO: 1168 - RNA, 19 nt, Artificial Sequence
  source: /note="Description of Artificial Sequence: Synthetic oligonucleotide"
cugaagauagagggugacc

SEQ ID NO: 1169 - RNA, 19 nt, Artificial Sequence
  source: /note="Description of Artificial Sequence: Synthetic oligonucleotide"
ccacggggcccggguggua

SEQ ID NO: 1170 - RNA, 19 nt, Artificial Sequence
  source: /note="Description of Artificial Sequence: Synthetic oligonucleotide"
acugguggccguggacaag

SEQ ID NO: 1171 - RNA, 19 nt, Artificial Sequence
  source: /note="Description of Artificial Sequence: Synthetic oligonucleotide"
uaagaagaacaaacugacg

SEQ ID NO: 1172 - RNA, 19 nt, Artificial Sequence
  source: /note="Description of Artificial Sequence: Synthetic oligonucleotide"
cgcagaguaagaucuggga

SEQ ID NO: 1173 - RNA, 19 nt, Artificial Sequence
  source: /note="Description of Artificial Sequence: Synthetic oligonucleotide"
gacgugguggagaaggcag

SEQ ID NO: 1174 - RNA, 19 nt, Artificial Sequence
  source: /note="Description of Artificial Sequence: Synthetic oligonucleotide"
accccgggcagugggaagg

SEQ ID NO: 1175 - RNA, 19 nt, Artificial Sequence
  source: /note="Description of Artificial Sequence: Synthetic oligonucleotide"
gauuacgccggugucuucu

SEQ ID NO: 1176 - RNA, 19 nt, Artificial Sequence
  source: /note="Description of Artificial Sequence: Synthetic oligonucleotide"
uccgacgcagggcugaccu

SEQ ID NO: 1177 - RNA, 19 nt, Artificial Sequence
  source: /note="Description of Artificial Sequence: Synthetic oligonucleotide"
uucacgagcagcaguggcc

SEQ ID NO: 1178 - RNA, 19 nt, Artificial Sequence
  source: /note="Description of Artificial Sequence: Synthetic oligonucleotide"
ccagcagaccgcccagagg

SEQ ID NO: 1179 - RNA, 19 nt, Artificial Sequence
  source: /note="Description of Artificial Sequence: Synthetic oligonucleotide"
ccgcccagagggcagaacu

SEQ ID NO: 1180 - RNA, 19 nt, Artificial Sequence
  source: /note="Description of Artificial Sequence: Synthetic oligonucleotide"
uucagugcccgcagccagc

SEQ ID NO: 1181 - RNA, 19 nt, Artificial Sequence
  source: /note="Description of Artificial Sequence: Synthetic oligonucleotide"
gccgcccgccgacgccguu

SEQ ID NO: 1182 - RNA, 19 nt, Artificial Sequence
  source: /note="Description of Artificial Sequence: Synthetic oligonucleotide"
acggagaagcgaauggaca

SEQ ID NO: 1183 - RNA, 19 nt, Artificial Sequence
  source: /note="Description of Artificial Sequence: Synthetic oligonucleotide"
aaagucggcaaguacccca

SEQ ID NO: 1184 - RNA, 19 nt, Artificial Sequence
  source: /note="Description of Artificial Sequence: Synthetic oligonucleotide"
caaggagcugcgcaagugc

SEQ ID NO: 1185 - RNA, 19 nt, Artificial Sequence
  source: /note="Description of Artificial Sequence: Synthetic oligonucleotide"
gcugcgaggacggcaugcg

SEQ ID NO: 1186 - RNA, 19 nt, Artificial Sequence
  source: /note="Description of Artificial Sequence: Synthetic oligonucleotide"
ccaugagguucucgugcca

SEQ ID NO: 1187 - RNA, 19 nt, Artificial Sequence
  source: /note="Description of Artificial Sequence: Synthetic oligonucleotide"
uucucgugccagcgccgga

SEQ ID NO: 1188 - RNA, 19 nt, Artificial Sequence
  source: /note="Description of Artificial Sequence: Synthetic oligonucleotide"
cguuucaucucccugggcg

SEQ ID NO: 1189 - RNA, 19 nt, Artificial Sequence
  source: /note="Description of Artificial Sequence: Synthetic oligonucleotide"
gaggcgugcaagaaggucu

SEQ ID NO: 1190 - RNA, 19 nt, Artificial Sequence
  source: /note="Description of Artificial Sequence: Synthetic oligonucleotide"
uuccuggacugcugcaacu

SEQ ID NO: 1191 - RNA, 19 nt, Artificial Sequence
  source: /note="Description of Artificial Sequence: Synthetic oligonucleotide"
cuacaucacagagcugcgg

SEQ ID NO: 1192 - RNA, 19 nt, Artificial Sequence
  source: /note="Description of Artificial Sequence: Synthetic oligonucleotide"
acgcgcgggccagccaccu

SEQ ID NO: 1193 - RNA, 19 nt, Artificial Sequence
  source: /note="Description of Artificial Sequence: Synthetic oligonucleotide"
ugggccuggccaggaguaa

SEQ ID NO: 1194 - RNA, 19 nt, Artificial Sequence
  source: /note="Description of Artificial Sequence: Synthetic oligonucleotide"
accuggaugaggacaucau

SEQ ID NO: 1195 - RNA, 19 nt, Artificial Sequence
  source: /note="Description of Artificial Sequence: Synthetic oligonucleotide"
uugcagaagagaacaucgu

SEQ ID NO: 1196 - RNA, 19 nt, Artificial Sequence
  source: /note="Description of Artificial Sequence: Synthetic oligonucleotide"
guuucccgaagugaguucc

SEQ ID NO: 1197 - RNA, 19 nt, Artificial Sequence
  source: /note="Description of Artificial Sequence: Synthetic oligonucleotide"
uucccagagagcuggcugu

SEQ ID NO: 1198 - RNA, 19 nt, Artificial Sequence
  source: /note="Description of Artificial Sequence: Synthetic oligonucleotide"
guggaacguugaggacuug

SEQ ID NO: 1199 - RNA, 19 nt, Artificial Sequence
  source: /note="Description of Artificial Sequence: Synthetic oligonucleotide"
uugaggacuugaaagagcc

SEQ ID NO: 1200 - RNA, 19 nt, Artificial Sequence
  source: /note="Description of Artificial Sequence: Synthetic oligonucleotide"
aggacuugaaagagccacc

SEQ ID NO: 1201 - RNA, 19 nt, Artificial Sequence
  source: /note="Description of Artificial Sequence: Synthetic oligonucleotide"
cgaaaaauggaaucucuac

SEQ ID NO: 1202 - RNA, 19 nt, Artificial Sequence
  source: /note="Description of Artificial Sequence: Synthetic oligonucleotide"
cucuacgaagcucaugaau

SEQ ID NO: 1203 - RNA, 19 nt, Artificial Sequence
  source: /note="Description of Artificial Sequence: Synthetic oligonucleotide"
uauauuuuugaaagacucc

SEQ ID NO: 1204 - RNA, 19 nt, Artificial Sequence
  source: /note="Description of Artificial Sequence: Synthetic oligonucleotide"
ccaucaccacgugggagau

SEQ ID NO: 1205 - RNA, 19 nt, Artificial Sequence
  source: /note="Description of Artificial Sequence: Synthetic oligonucleotide"
auucuggcugugagcaugu

SEQ ID NO: 1206 - RNA, 19 nt, Artificial Sequence
  source: /note="Description of Artificial Sequence: Synthetic oligonucleotide"
ucggacaagaaagggaucu

SEQ ID NO: 1207 - RNA, 19 nt, Artificial Sequence
  source: /note="Description of Artificial Sequence: Synthetic oligonucleotide"
gcagaccccuucgagguca

SEQ ID NO: 1208 - RNA, 19 nt, Artificial Sequence
  source: /note="Description of Artificial Sequence: Synthetic oligonucleotide"
uucaucgaccugcggcuac

SEQ ID NO: 1209 - RNA, 19 nt, Artificial Sequence
  source: /note="Description of Artificial Sequence: Synthetic oligonucleotide"
acccuacucuguuguucga

SEQ ID NO: 1210 - RNA, 19 nt, Artificial Sequence
  source: /note="Description of Artificial Sequence: Synthetic oligonucleotide"
cuguuguucgaaacgagca

SEQ ID NO: 1211 - RNA, 19 nt, Artificial Sequence
  source: /note="Description of Artificial Sequence: Synthetic oligonucleotide"
cagguggaaauccgagccg

SEQ ID NO: 1212 - RNA, 19 nt, Artificial Sequence
  source: /note="Description of Artificial Sequence: Synthetic oligonucleotide"
cguucucuacaauuaccgg

SEQ ID NO: 1213 - RNA, 19 nt, Artificial Sequence
  source: /note="Description of Artificial Sequence: Synthetic oligonucleotide"
aagagcucaaggugagggu

SEQ ID NO: 1214 - RNA, 19 nt, Artificial Sequence
  source: /note="Description of Artificial Sequence: Synthetic oligonucleotide"
guggaacuacuccacaauc

SEQ ID NO: 1215 - RNA, 19 nt, Artificial Sequence
  source: /note="Description of Artificial Sequence: Synthetic oligonucleotide"
uacuccacaauccagccuu

SEQ ID NO: 1216 - RNA, 19 nt, Artificial Sequence
  source: /note="Description of Artificial Sequence: Synthetic oligonucleotide"
uucugcagccuggccacca

SEQ ID NO: 1217 - RNA, 19 nt, Artificial Sequence
  source: /note="Description of Artificial Sequence: Synthetic oligonucleotide"
caccaagaggcgucaccag

SEQ ID NO: 1218 - RNA, 19 nt, Artificial Sequence
  source: /note="Description of Artificial Sequence: Synthetic oligonucleotide"
agcagaccguaaccauccc

SEQ ID NO: 1219 - RNA, 19 nt, Artificial Sequence
  source: /note="Description of Artificial Sequence: Synthetic oligonucleotide"
uccucguuguccguuccau

SEQ ID NO: 1220 - RNA, 19 nt, Artificial Sequence
  source: /note="Description of Artificial Sequence: Synthetic oligonucleotide"
uaugucaucgugccgcuaa

SEQ ID NO: 1221 - RNA, 19 nt, Artificial Sequence
  source: /note="Description of Artificial Sequence: Synthetic oligonucleotide"
agaccggccugcaggaagu

SEQ ID NO: 1222 - RNA, 19 nt, Artificial Sequence
  source: /note="Description of Artificial Sequence: Synthetic oligonucleotide"
guggaagucaaggcugcug

SEQ ID NO: 1223 - RNA, 19 nt, Artificial Sequence
  source: /note="Description of Artificial Sequence: Synthetic oligonucleotide"
uucaucagugacgguguca

SEQ ID NO: 1224 - RNA, 19 nt, Artificial Sequence
  source: /note="Description of Artificial Sequence: Synthetic oligonucleotide"
caggaagucccugaagguc

SEQ ID NO: 1225 - RNA, 19 nt, Artificial Sequence
  source: /note="Description of Artificial Sequence: Synthetic oligonucleotide"
aaucagaaugaacaaaacu

SEQ ID NO: 1226 - RNA, 19 nt, Artificial Sequence
  source: /note="Description of Artificial Sequence: Synthetic oligonucleotide"
cuguggcuguucgcacccu

SEQ ID NO: 1227 - RNA, 19 nt, Artificial Sequence
  source: /note="Description of Artificial Sequence: Synthetic oligonucleotide"
cuggauccagaacgccugg

SEQ ID NO: 1228 - RNA, 19 nt, Artificial Sequence
  source: /note="Description of Artificial Sequence: Synthetic oligonucleotide"
aaggagugcagaaagagga

SEQ ID NO: 1229 - RNA, 19 nt, Artificial Sequence
  source: /note="Description of Artificial Sequence: Synthetic oligonucleotide"
gugaccaagucccggacac

SEQ ID NO: 1230 - RNA, 19 nt, Artificial Sequence
  source: /note="Description of Artificial Sequence: Synthetic oligonucleotide"
ccgagucugagaccagaau

SEQ ID NO: 1231 - RNA, 19 nt, Artificial Sequence
  source: /note="Description of Artificial Sequence: Synthetic oligonucleotide"
uucuccugcaagggacccc

SEQ ID NO: 1232 - RNA, 19 nt, Artificial Sequence
  source: /note="Description of Artificial Sequence: Synthetic oligonucleotide"
ccaguggcccagaugacag

SEQ ID NO: 1233 - RNA, 19 nt, Artificial Sequence
  source: /note="Description of Artificial Sequence: Synthetic oligonucleotide"
cgucgacgcggaacggcug

SEQ ID NO: 1234 - RNA, 19 nt, Artificial Sequence
  source: /note="Description of Artificial Sequence: Synthetic oligonucleotide"
cggggaacagaacaugauc

SEQ ID NO: 1235 - RNA, 19 nt, Artificial Sequence
  source: /note="Description of Artificial Sequence: Synthetic oligonucleotide"
ucggcaugacgcccacggu

SEQ ID NO: 1236 - RNA, 19 nt, Artificial Sequence
  source: /note="Description of Artificial Sequence: Synthetic oligonucleotide"
uaccuggaugaaacggagc

SEQ ID NO: 1237 - RNA, 19 nt, Artificial Sequence
  source: /note="Description of Artificial Sequence: Synthetic oligonucleotide"
uggaugaaacggagcagug

SEQ ID NO: 1238 - RNA, 19 nt, Artificial Sequence
  source: /note="Description of Artificial Sequence: Synthetic oligonucleotide"
gggagaaguucggccuaga

SEQ ID NO: 1239 - RNA, 19 nt, Artificial Sequence
  source: /note="Description of Artificial Sequence: Synthetic oligonucleotide"
agaagcggcagggggccuu

SEQ ID NO: 1240 - RNA, 19 nt, Artificial Sequence
  source: /note="Description of Artificial Sequence: Synthetic oligonucleotide"
uuggagcucaucaagaagg

SEQ ID NO: 1241 - RNA, 19 nt, Artificial Sequence
  source: /note="Description of Artificial Sequence: Synthetic oligonucleotide"
gagcucaucaagaaggggu

SEQ ID NO: 1242 - RNA, 19 nt, Artificial Sequence
  source: /note="Description of Artificial Sequence: Synthetic oligonucleotide"
uacacccagcagcuggccu

SEQ ID NO: 1243 - RNA, 19 nt, Artificial Sequence
  source: /note="Description of Artificial Sequence: Synthetic oligonucleotide"
cuucagacaacccagcucu

SEQ ID NO: 1244 - RNA, 19 nt, Artificial Sequence
  source: /note="Description of Artificial Sequence: Synthetic oligonucleotide"
agcucugccuuugcggccu

SEQ ID NO: 1245 - RNA, 19 nt, Artificial Sequence
  source: /note="Description of Artificial Sequence: Synthetic oligonucleotide"
uucgugaaacgggcaccca

SEQ ID NO: 1246 - RNA, 19 nt, Artificial Sequence
  source: /note="Description of Artificial Sequence: Synthetic oligonucleotide"
cagcaccuggcugaccgcc

SEQ ID NO: 1247 - RNA, 19 nt, Artificial Sequence
  source: /note="Description of Artificial Sequence: Synthetic oligonucleotide"
uacguggucaaggucuucu

SEQ ID NO: 1248 - RNA, 19 nt, Artificial Sequence
  source: /note="Description of Artificial Sequence: Synthetic oligonucleotide"
cucucuggcugucaaccuc

SEQ ID NO: 1249 - RNA, 19 nt, Artificial Sequence
  source: /note="Description of Artificial Sequence: Synthetic oligonucleotide"
uggcugauccuggagaagc

SEQ ID NO: 1250 - RNA, 19 nt, Artificial Sequence
  source: /note="Description of Artificial Sequence: Synthetic oligonucleotide"
cagaagcccgacggggucu

SEQ ID NO: 1251 - RNA, 19 nt, Artificial Sequence
  source: /note="Description of Artificial Sequence: Synthetic oligonucleotide"
gucuuccaggaggaugcgc

SEQ ID NO: 1252 - RNA, 19 nt, Artificial Sequence
  source: /note="Description of Artificial Sequence: Synthetic oligonucleotide"
cccgugauacaccaagaaa

SEQ ID NO: 1253 - RNA, 19 nt, Artificial Sequence
  source: /note="Description of Artificial Sequence: Synthetic oligonucleotide"
augauugguggauuacgga

SEQ ID NO: 1254 - RNA, 19 nt, Artificial Sequence
  source: /note="Description of Artificial Sequence: Synthetic oligonucleotide"
aacaacaacgagaaagaca

SEQ ID NO: 1255 - RNA, 19 nt, Artificial Sequence
  source: /note="Description of Artificial Sequence: Synthetic oligonucleotide"
uuuguucucaucucgcugc

SEQ ID NO: 1256 - RNA, 19 nt, Artificial Sequence
  source: /note="Description of Artificial Sequence: Synthetic oligonucleotide"
caggaggcuaaagauauuu

SEQ ID NO: 1257 - RNA, 19 nt, Artificial Sequence
  source: /note="Description of Artificial Sequence: Synthetic oligonucleotide"
uugcgaggagcaggucaac

SEQ ID NO: 1258 - RNA, 19 nt, Artificial Sequence
  source: /note="Description of Artificial Sequence: Synthetic oligonucleotide"
acagccugccaggcagcau

SEQ ID NO: 1259 - RNA, 19 nt, Artificial Sequence
  source: /note="Description of Artificial Sequence: Synthetic oligonucleotide"
gccugccaggcagcaucac

SEQ ID NO: 1260 - RNA, 19 nt, Artificial Sequence
  source: /note="Description of Artificial Sequence: Synthetic oligonucleotide"
cuaaagcaggagacuuccu

SEQ ID NO: 1261 - RNA, 19 nt, Artificial Sequence
  source: /note="Description of Artificial Sequence: Synthetic oligonucleotide"
cuugaagccaacuacauga

SEQ ID NO: 1262 - RNA, 19 nt, Artificial Sequence
  source: /note="Description of Artificial Sequence: Synthetic oligonucleotide"
uacaugaaccuacagagau

SEQ ID NO: 1263 - RNA, 19 nt, Artificial Sequence
  source: /note="Description of Artificial Sequence: Synthetic oligonucleotide"
auccuacacuguggccauu

SEQ ID NO: 1264 - RNA, 19 nt, Artificial Sequence
  source: /note="Description of Artificial Sequence: Synthetic oligonucleotide"
uugcuggcuaugcucuggc

SEQ ID NO: 1265 - RNA, 19 nt, Artificial Sequence
  source: /note="Description of Artificial Sequence: Synthetic oligonucleotide"
gaaggggccucuucuuaac

SEQ ID NO: 1266 - RNA, 19 nt, Artificial Sequence
  source: /note="Description of Artificial Sequence: Synthetic oligonucleotide"
caaauuucugaccacagcc

SEQ ID NO: 1267 - RNA, 19 nt, Artificial Sequence
  source: /note="Description of Artificial Sequence: Synthetic oligonucleotide"
caaagauaagaaccgcugg

SEQ ID NO: 1268 - RNA, 19 nt, Artificial Sequence
  source: /note="Description of Artificial Sequence: Synthetic oligonucleotide"
gggaggacccugguaagca

SEQ ID NO: 1269 - RNA, 19 nt, Artificial Sequence
  source: /note="Description of Artificial Sequence: Synthetic oligonucleotide"
gacccugguaagcagcucu

SEQ ID NO: 1270 - RNA, 19 nt, Artificial Sequence
  source: /note="Description of Artificial Sequence: Synthetic oligonucleotide"
uacaacguggaggccacau

SEQ ID NO: 1271 - RNA, 19 nt, Artificial Sequence
  source: /note="Description of Artificial Sequence: Synthetic oligonucleotide"
ccuaugcccucuuggcccu

SEQ ID NO: 1272 - RNA, 19 nt, Artificial Sequence
  source: /note="Description of Artificial Sequence: Synthetic oligonucleotide"
uacugcagcuaaaagacuu

SEQ ID NO: 1273 - RNA, 19 nt, Artificial Sequence
  source: /note="Description of Artificial Sequence: Synthetic oligonucleotide"
cgucgugcguuggcucaau

SEQ ID NO: 1274 - RNA, 19 nt, Artificial Sequence
  source: /note="Description of Artificial Sequence: Synthetic oligonucleotide"
caaugaacagagauacuac

SEQ ID NO: 1275 - RNA, 19 nt, Artificial Sequence
  source: /note="Description of Artificial Sequence: Synthetic oligonucleotide"
acggugguggcuauggcuc

SEQ ID NO: 1276 - RNA, 19 nt, Artificial Sequence
  source: /note="Description of Artificial Sequence: Synthetic oligonucleotide"
ucuacccaggccaccuuca

SEQ ID NO: 1277 - RNA, 19 nt, Artificial Sequence
  source: /note="Description of Artificial Sequence: Synthetic oligonucleotide"
uucaugguguuccaagccu

SEQ ID NO: 1278 - RNA, 19 nt, Artificial Sequence
  source: /note="Description of Artificial Sequence: Synthetic oligonucleotide"
cuuggcucaauaccaaaag

SEQ ID NO: 1279 - RNA, 19 nt, Artificial Sequence
  source: /note="Description of Artificial Sequence: Synthetic oligonucleotide"
aggacgccccugaccacca

SEQ ID NO: 1280 - RNA, 19 nt, Artificial Sequence
  source: /note="Description of Artificial Sequence: Synthetic oligonucleotide"
caggaacugaaccuugaug

SEQ ID NO: 1281 - RNA, 19 nt, Artificial Sequence
  source: /note="Description of Artificial Sequence: Synthetic oligonucleotide"
uugaugugucccuccaacu

SEQ ID NO: 1282 - RNA, 19 nt, Artificial Sequence
  source: /note="Description of Artificial Sequence: Synthetic oligonucleotide"
cugcccagccgcagcucca

SEQ ID NO: 1283 - RNA, 19 nt, Artificial Sequence
  source: /note="Description of Artificial Sequence: Synthetic oligonucleotide"
cgcagcuccaagaucaccc

SEQ ID NO: 1284 - RNA, 19 nt, Artificial Sequence
  source: /note="Description of Artificial Sequence: Synthetic oligonucleotide"
ccaccguauccacugggaa

SEQ ID NO: 1285 - RNA, 19 nt, Artificial Sequence
  source: /note="Description of Artificial Sequence: Synthetic oligonucleotide"
ccguauccacugggaaucu

SEQ ID NO: 1286 - RNA, 19 nt, Artificial Sequence
  source: /note="Description of Artificial Sequence: Synthetic oligonucleotide"
ugccagccuccugcgauca

SEQ ID NO: 1287 - RNA, 19 nt, Artificial Sequence
  source: /note="Description of Artificial Sequence: Synthetic oligonucleotide"
agaagagaccaaggaaaau

SEQ ID NO: 1288 - RNA, 19 nt, Artificial Sequence
  source: /note="Description of Artificial Sequence: Synthetic oligonucleotide"
augaggguuucacagucac

SEQ ID NO: 1289 - RNA, 19 nt, Artificial Sequence
  source: /note="Description of Artificial Sequence: Synthetic oligonucleotide"
acagcugaaggaaaaggcc

SEQ ID NO: 1290 - RNA, 19 nt, Artificial Sequence
  source: /note="Description of Artificial Sequence: Synthetic oligonucleotide"
ccaaggcaccuugucggug

SEQ ID NO: 1291 - RNA, 19 nt, Artificial Sequence
  source: /note="Description of Artificial Sequence: Synthetic oligonucleotide"
uugucgguggugacaaugu

SEQ ID NO: 1292 - RNA, 19 nt, Artificial Sequence
  source: /note="Description of Artificial Sequence: Synthetic oligonucleotide"
guaccaugcuaaggccaaa

SEQ ID NO: 1293 - RNA, 19 nt, Artificial Sequence
  source: /note="Description of Artificial Sequence: Synthetic oligonucleotide"
cuaaggccaaagaucaacu

SEQ ID NO: 1294 - RNA, 19 nt, Artificial Sequence
  source: /note="Description of Artificial Sequence: Synthetic oligonucleotide"
caacucaccuguaauaaau

SEQ ID NO: 1295 - RNA, 19 nt, Artificial Sequence
  source: /note="Description of Artificial Sequence: Synthetic oligonucleotide"
uucgaccucaaggucacca

SEQ ID NO: 1296 - RNA, 19 nt, Artificial Sequence
  source: /note="Description of Artificial Sequence: Synthetic oligonucleotide"
ucaccauaaaaccagcacc

SEQ ID NO: 1297 - RNA, 19 nt, Artificial Sequence
  source: /note="Description of Artificial Sequence: Synthetic oligonucleotide"
cggaaacagaaaagaggcc

SEQ ID NO: 1298 - RNA, 19 nt, Artificial Sequence
  source: /note="Description of Artificial Sequence: Synthetic oligonucleotide"
ucaggaugccaagaacacu

SEQ ID NO: 1299 - RNA, 19 nt, Artificial Sequence
  source: /note="Description of Artificial Sequence: Synthetic oligonucleotide"
uaugauccuugagaucugu

SEQ ID NO: 1300 - RNA, 19 nt, Artificial Sequence
  source: /note="Description of Artificial Sequence: Synthetic oligonucleotide"
ccagguaccggggagacca

SEQ ID NO: 1301 - RNA, 19 nt, Artificial Sequence
  source: /note="Description of Artificial Sequence: Synthetic oligonucleotide"
caggaugccacuaugucua

SEQ ID NO: 1302 - RNA, 19 nt, Artificial Sequence
  source: /note="Description of Artificial Sequence: Synthetic oligonucleotide"
cuuugcuccagacacagau

SEQ ID NO: 1303 - RNA, 19 nt, Artificial Sequence
  source: /note="Description of Artificial Sequence: Synthetic oligonucleotide"
augaccugaagcagcuggc

SEQ ID NO: 1304 - RNA, 19 nt, Artificial Sequence
  source: /note="Description of Artificial Sequence: Synthetic oligonucleotide"
uugacagauacaucuccaa

SEQ ID NO: 1305 - RNA, 19 nt, Artificial Sequence
  source: /note="Description of Artificial Sequence: Synthetic oligonucleotide"
aaguaugagcuggacaaag

SEQ ID NO: 1306 - RNA, 19 nt, Artificial Sequence
  source: /note="Description of Artificial Sequence: Synthetic oligonucleotide"
uaugagcuggacaaagccu

SEQ ID NO: 1307 - RNA, 19 nt, Artificial Sequence
  source: /note="Description of Artificial Sequence: Synthetic oligonucleotide"
cuucuccgauaggaacacc

SEQ ID NO: 1308 - RNA, 19 nt, Artificial Sequence
  source: /note="Description of Artificial Sequence: Synthetic oligonucleotide"
cccucaucaucuaccugga

SEQ ID NO: 1309 - RNA, 19 nt, Artificial Sequence
  source: /note="Description of Artificial Sequence: Synthetic oligonucleotide"
gacaaggucucacacucug

SEQ ID NO: 1310 - RNA, 19 nt, Artificial Sequence
  source: /note="Description of Artificial Sequence: Synthetic oligonucleotide"
ucacacucugaggaugacu

SEQ ID NO: 1311 - RNA, 19 nt, Artificial Sequence
  source: /note="Description of Artificial Sequence: Synthetic oligonucleotide"
gaggaugacugucuagcuu

SEQ ID NO: 1312 - RNA, 19 nt, Artificial Sequence
  source: /note="Description of Artificial Sequence: Synthetic oligonucleotide"
uucaaaguucaccaauacu

SEQ ID NO: 1313 - RNA, 19 nt, Artificial Sequence
  source: /note="Description of Artificial Sequence: Synthetic oligonucleotide"
cuuuaauguagagcuuauc

SEQ ID NO: 1314 - RNA, 19 nt, Artificial Sequence
  source: /note="Description of Artificial Sequence: Synthetic oligonucleotide"
gucaaggucuacgccuauu

SEQ ID NO: 1315 - RNA, 19 nt, Artificial Sequence
  source: /note="Description of Artificial Sequence: Synthetic oligonucleotide"
uacaaccuggaggaaagcu

SEQ ID NO: 1316 - RNA, 19 nt, Artificial Sequence
  source: /note="Description of Artificial Sequence: Synthetic oligonucleotide"
cuguacccgguucuaccau

SEQ ID NO: 1317 - RNA, 19 nt, Artificial Sequence
  source: /note="Description of Artificial Sequence: Synthetic oligonucleotide"
auccggaaaaggaggaugg

SEQ ID NO: 1318 - RNA, 19 nt, Artificial Sequence
  source: /note="Description of Artificial Sequence: Synthetic oligonucleotide"
aaaaggaggauggaaagcu

SEQ ID NO: 1319 - RNA, 19 nt, Artificial Sequence
  source: /note="Description of Artificial Sequence: Synthetic oligonucleotide"
cugaacaagcucugccgug

SEQ ID NO: 1320 - RNA, 19 nt, Artificial Sequence
  source: /note="Description of Artificial Sequence: Synthetic oligonucleotide"
ugaugaacugugccgcugu

SEQ ID NO: 1321 - RNA, 19 nt, Artificial Sequence
  source: /note="Description of Artificial Sequence: Synthetic oligonucleotide"
gugcugaggagaauugcuu

SEQ ID NO: 1322 - RNA, 19 nt, Artificial Sequence
  source: /note="Description of Artificial Sequence: Synthetic oligonucleotide"
aauugcuucauacaaaagu

SEQ ID NO: 1323 - RNA, 19 nt, Artificial Sequence
  source: /note="Description of Artificial Sequence: Synthetic oligonucleotide"
gucggaugacaaggucacc

SEQ ID NO: 1324 - RNA, 19 nt, Artificial Sequence
  source: /note="Description of Artificial Sequence: Synthetic oligonucleotide"
cccuggaagaacggcugga

SEQ ID NO: 1325 - RNA, 19 nt, Artificial Sequence
  source: /note="Description of Artificial Sequence: Synthetic oligonucleotide"
gacaaggccugugagccag

SEQ ID NO: 1326 - RNA, 19 nt, Artificial Sequence
  source: /note="Description of Artificial Sequence: Synthetic oligonucleotide"
aggccugugagccaggagu

SEQ ID NO: 1327 - RNA, 19 nt, Artificial Sequence
  source: /note="Description of Artificial Sequence: Synthetic oligonucleotide"
ccaggaguggacuaugugu

SEQ ID NO: 1328 - RNA, 19 nt, Artificial Sequence
  source: /note="Description of Artificial Sequence: Synthetic oligonucleotide"
uacaagacccgacugguca

SEQ ID NO: 1329 - RNA, 19 nt, Artificial Sequence
  source: /note="Description of Artificial Sequence: Synthetic oligonucleotide"
uucagcuguccaaugacuu

SEQ ID NO: 1330 - RNA, 19 nt, Artificial Sequence
  source: /note="Description of Artificial Sequence: Synthetic oligonucleotide"
uuugacgaguacaucaugg

SEQ ID NO: 1331 - RNA, 19 nt, Artificial Sequence
  source: /note="Description of Artificial Sequence: Synthetic oligonucleotide"
uacaucauggccauugagc

SEQ ID NO: 1332 - RNA, 19 nt, Artificial Sequence
  source: /note="Description of Artificial Sequence: Synthetic oligonucleotide"
cagaccaucaagucaggcu

SEQ ID NO: 1333 - RNA, 19 nt, Artificial Sequence
  source: /note="Description of Artificial Sequence: Synthetic oligonucleotide"
cucggaugaggugcagguu

SEQ ID NO: 1334 - RNA, 19 nt, Artificial Sequence
  source: /note="Description of Artificial Sequence: Synthetic oligonucleotide"
uucaucagccccaucaagu

SEQ ID NO: 1335 - RNA, 19 nt, Artificial Sequence
  source: /note="Description of Artificial Sequence: Synthetic oligonucleotide"
ucaagugcagagaagcccu

SEQ ID NO: 1336 - RNA, 19 nt, Artificial Sequence
  source: /note="Description of Artificial Sequence: Synthetic oligonucleotide"
cugaagcuggaggagaaga

SEQ ID NO: 1337 - RNA, 19 nt, Artificial Sequence
  source: /note="Description of Artificial Sequence: Synthetic oligonucleotide"
aagcuggaggagaagaaac

SEQ ID NO: 1338 - RNA, 19 nt, Artificial Sequence
  source: /note="Description of Artificial Sequence: Synthetic oligonucleotide"
acacuaccucauguggggu

SEQ ID NO: 1339 - RNA, 19 nt, Artificial Sequence
  source: /note="Description of Artificial Sequence: Synthetic oligonucleotide"
uucuggggagagaagccca

SEQ ID NO: 1340 - RNA, 19 nt, Artificial Sequence
  source: /note="Description of Artificial Sequence: Synthetic oligonucleotide"
uacaucaucgggaaggaca

SEQ ID NO: 1341 - RNA, 19 nt, Artificial Sequence
  source: /note="Description of Artificial Sequence: Synthetic oligonucleotide"
cacuuggguggagcacugg

SEQ ID NO: 1342 - RNA, 19 nt, Artificial Sequence
  source: /note="Description of Artificial Sequence: Synthetic oligonucleotide"
aggacgaaugccaagacga

SEQ ID NO: 1343 - RNA, 19 nt, Artificial Sequence
  source: /note="Description of Artificial Sequence: Synthetic oligonucleotide"
aagagaaccagaaacaaug

SEQ ID NO: 1344 - RNA, 19 nt, Artificial Sequence
  source: /note="Description of Artificial Sequence: Synthetic oligonucleotide"
ugccaggaccucggcgccu

SEQ ID NO: 1345 - RNA, 19 nt, Artificial Sequence
  source: /note="Description of Artificial Sequence: Synthetic oligonucleotide"
cuucaccgagagcaugguu

SEQ ID NO: 1346 - RNA, 19 nt, Artificial Sequence
  source: /note="Description of Artificial Sequence: Synthetic oligonucleotide"
cacacccccauucccccac

SEQ ID NO: 1347 - RNA, 19 nt, Artificial Sequence
  source: /note="Description of Artificial Sequence: Synthetic oligonucleotide"
cuccagauaaagcuucagu

SEQ ID NO: 1348 - RNA, 19 nt, Artificial Sequence
  source: /note="Description of Artificial Sequence: Synthetic oligonucleotide"
uuauaucucaaaaaaaaaa

SEQ ID NO: 1349 - protein, 16 aa, Unknown
  source: /note="Description of Unknown: RFGF peptide"
AAVALLPAVLLALLAP

SEQ ID NO: 1350 - protein, 11 aa, Unknown
  source: /note="Description of Unknown: RFGF analogue peptide"
AALLPVLLAAP

SEQ ID NO: 1351 - protein, 13 aa, Human immunodeficiency virus
GRKKRRQRRRPPQ

SEQ ID NO: 1352 - protein, 16 aa, Drosophila sp.
RQIKIWFQNRRMKWKK

SEQ ID NO: 1353 - RNA, 21 nt, Artificial Sequence
  source: /note="Description of Artificial Sequence: Synthetic oligonucleotide"
gcugaggagaauugcuucaua

SEQ ID NO: 1354 - RNA, 21 nt, Artificial Sequence
  source: /note="Description of Artificial Sequence: Synthetic oligonucleotide"
ggagaauugcuucauacaaaa

SEQ ID NO: 1355 - RNA, 21 nt, Artificial Sequence
  source: /note="Description of Artificial Sequence: Synthetic oligonucleotide"
gcagcuaaaagacuuugacuu

SEQ ID NO: 1356 - RNA, 21 nt, Artificial Sequence
  source: /note="Description of Artificial Sequence: Synthetic oligonucleotide"
auccagacagacaagaccauu

SEQ ID NO: 1357 - RNA, 21 nt, Artificial Sequence
  source: /note="Description of Artificial Sequence: Synthetic oligonucleotide"
gacagacaagaccaucuacaa

SEQ ID NO: 1358 - RNA, 21 nt, Artificial Sequence
  source: /note="Description of Artificial Sequence: Synthetic oligonucleotide"
cguggucaaggucuucucucu

SEQ ID NO: 1359 - RNA, 21 nt, Artificial Sequence
  source: /note="Description of Artificial Sequence: Synthetic oligonucleotide"
uccagacagacaagaccaucu

SEQ ID NO: 1360 - RNA, 21 nt, Artificial Sequence
  source: /note="Description of Artificial Sequence: Synthetic oligonucleotide"
augaacaaaacuguggcuguu

SEQ ID NO: 1361 - RNA, 21 nt, Artificial Sequence
  source: /note="Description of Artificial Sequence: Synthetic oligonucleotide"
cuucaugguauuccaagccuu

SEQ ID NO: 1362 - RNA, 21 nt, Artificial Sequence
  source: /note="Description of Artificial Sequence: Synthetic oligonucleotide"
cauccagacagacaagaccau

SEQ ID NO: 1363 - RNA, 21 nt, Artificial Sequence
  source: /note="Description of Artificial Sequence: Synthetic oligonucleotide"
ccagacagacaagaccaucua

SEQ ID NO: 1364 - RNA, 21 nt, Artificial Sequence
  source: /note="Description of Artificial Sequence: Synthetic oligonucleotide"
gacagacaagaccaucuacac

SEQ ID NO: 1365 - RNA, 21 nt, Artificial Sequence
  source: /note="Description of Artificial Sequence: Synthetic oligonucleotide"
uacguggucaaggucuucucu

SEQ ID NO: 1366 - RNA, 21 nt, Artificial Sequence
  source: /note="Description of Artificial Sequence: Synthetic oligonucleotide"
agacagacaagaccaucuaca

SEQ ID NO: 1367 - RNA, 21 nt, Artificial Sequence
  source: /note="Description of Artificial Sequence: Synthetic oligonucleotide"
acguggucaaggucuucucuc

SEQ ID NO: 1368 - RNA, 21 nt, Artificial Sequence
  source: /note="Description of Artificial Sequence: Synthetic oligonucleotide"
agaaaaauggaaucucuacga

SEQ ID NO: 1369 - RNA, 21 nt, Artificial Sequence
  source: /note="Description of Artificial Sequence: Synthetic oligonucleotide"
uuugaccucaugguguucguu

SEQ ID NO: 1370 - RNA, 21 nt, Artificial Sequence
  source: /note="Description of Artificial Sequence: Synthetic oligonucleotide"
gacaagaccaucuacaccccu

SEQ ID NO: 1371 - RNA, 21 nt, Artificial Sequence
  source: /note="Description of Artificial Sequence: Synthetic oligonucleotide"
gaaagggaucuguguggcaga

SEQ ID NO: 1372 - RNA, 21 nt, Artificial Sequence
  source: /note="Description of Artificial Sequence: Synthetic oligonucleotide"
ccagauccacuucaccaagac

SEQ ID NO: 1373 - RNA, 21 nt, Artificial Sequence
  source: /note="Description of Artificial Sequence: Synthetic oligonucleotide"
uguaauaaauucgaccucaag

SEQ ID NO: 1374 - RNA, 21 nt, Artificial Sequence
  source: /note="Description of Artificial Sequence: Synthetic oligonucleotide"
auccagacagacaagaccauc

SEQ ID NO: 1375 - RNA, 21 nt, Artificial Sequence
  source: /note="Description of Artificial Sequence: Synthetic oligonucleotide"
aacaagaagaacaaacucaca

SEQ ID NO: 1376 - RNA, 21 nt, Artificial Sequence
  source: /note="Description of Artificial Sequence: Synthetic oligonucleotide"
cuucaccaagacacccaaauu

SEQ ID NO: 1377 - RNA, 21 nt, Artificial Sequence
  source: /note="Description of Artificial Sequence: Synthetic oligonucleotide"
ugaccucaugguguucgugau

SEQ ID NO: 1378 - RNA, 21 nt, Artificial Sequence
  source: /note="Description of Artificial Sequence: Synthetic oligonucleotide"
ccccuucgaggucacaguaau

SEQ ID NO: 1379 - RNA, 21 nt, Artificial Sequence
  source: /note="Description of Artificial Sequence: Synthetic oligonucleotide"
acagacaagaccaucuacaca

SEQ ID NO: 1380 - RNA, 21 nt, Artificial Sequence
  source: /note="Description of Artificial Sequence: Synthetic oligonucleotide"
auucaccaagaaaugauuggu

SEQ ID NO: 1381 - RNA, 21 nt, Artificial Sequence
  source: /note="Description of Artificial Sequence: Synthetic oligonucleotide"
ggaugccaagaacacuaugau

SEQ ID NO: 1382 - RNA, 21 nt, Artificial Sequence
  source: /note="Description of Artificial Sequence: Synthetic oligonucleotide"
aacuacaugaaccuacagaga

SEQ ID NO: 1383 - RNA, 21 nt, Artificial Sequence
  source: /note="Description of Artificial Sequence: Synthetic oligonucleotide"
ugaccucaugguguucgugac

SEQ ID NO: 1384 - RNA, 21 nt, Artificial Sequence
  source: /note="Description of Artificial Sequence: Synthetic oligonucleotide"
cgugacagugguggcaaacuu

SEQ ID NO: 1385 - RNA, 21 nt, Artificial Sequence
  source: /note="Description of Artificial Sequence: Synthetic oligonucleotide"
caguuucgaggucauagugga

SEQ ID NO: 1386 - RNA, 21 nt, Artificial Sequence
  source: /note="Description of Artificial Sequence: Synthetic oligonucleotide"
agggaucuguguggcagacca

SEQ ID NO: 1387 - RNA, 21 nt, Artificial Sequence
  source: /note="Description of Artificial Sequence: Synthetic oligonucleotide"
agggaucuguguggcagaccc

SEQ ID NO: 1388 - RNA, 21 nt, Artificial Sequence
  source: /note="Description of Artificial Sequence: Synthetic oligonucleotide"
acguggucaaggucuucucua

SEQ ID NO: 1389 - RNA, 21 nt, Artificial Sequence
  source: /note="Description of Artificial Sequence: Synthetic oligonucleotide"
uugccuuugucuuggaacauu

SEQ ID NO: 1390 - RNA, 21 nt, Artificial Sequence
  source: /note="Description of Artificial Sequence: Synthetic oligonucleotide"
cauagaagaguugaaagaacc

SEQ ID NO: 1391 - RNA, 21 nt, Artificial Sequence
  source: /note="Description of Artificial Sequence: Synthetic oligonucleotide"
cgugccggaaggaaucagaau

SEQ ID NO: 1392 - RNA, 21 nt, Artificial Sequence
  source: /note="Description of Artificial Sequence: Synthetic oligonucleotide"
cuccguguggguggacgucaa

SEQ ID NO: 1393 - RNA, 21 nt, Artificial Sequence
  source: /note="Description of Artificial Sequence: Synthetic oligonucleotide"
uugaccucaugguguucguga

SEQ ID NO: 1394 - RNA, 21 nt, Artificial Sequence
  source: /note="Description of Artificial Sequence: Synthetic oligonucleotide"
cugcugaaagacuuugacucu

SEQ ID NO: 1395 - RNA, 21 nt, Artificial Sequence
  source: /note="Description of Artificial Sequence: Synthetic oligonucleotide"
caagaaagggaucugugugga

SEQ ID NO: 1396 - RNA, 21 nt, Artificial Sequence
  source: /note="Description of Artificial Sequence: Synthetic oligonucleotide"
aagaaagggaucuguguggca

SEQ ID NO: 1397 - RNA, 21 nt, Artificial Sequence
  source: /note="Description of Artificial Sequence: Synthetic oligonucleotide"
uuugaccucaugguguucgug

SEQ ID NO: 1398 - RNA, 21 nt, Artificial Sequence
  source: /note="Description of Artificial Sequence: Synthetic oligonucleotide"
cacugugcaagacuuccuaaa

SEQ ID NO: 1399 - RNA, 21 nt, Artificial Sequence
  source: /note="Description of Artificial Sequence: Synthetic oligonucleotide"
cugguuguggaccauagaaga

SEQ ID NO: 1400 - RNA, 21 nt, Artificial Sequence
  source: /note="Description of Artificial Sequence: Synthetic oligonucleotide"
uguuaaauggcugauccugga

SEQ ID NO: 1401 - RNA, 21 nt, Artificial Sequence
  source: /note="Description of Artificial Sequence: Synthetic oligonucleotide"
ggaucuguguggcagaccccu

SEQ ID NO: 1402 - RNA, 21 nt, Artificial Sequence
  source: /note="Description of Artificial Sequence: Synthetic oligonucleotide"
acagacaagaccaucuacacc

SEQ ID NO: 1403 - RNA, 21 nt, Artificial Sequence
  source: /note="Description of Artificial Sequence: Synthetic oligonucleotide"
guacgugacagugguggcaaa

SEQ ID NO: 1404 - RNA, 21 nt, Artificial Sequence
  source: /note="Description of Artificial Sequence: Synthetic oligonucleotide"
ggucaugaacaucuuucucaa

SEQ ID NO: 1405 - RNA, 21 nt, Artificial Sequence
  source: /note="Description of Artificial Sequence: Synthetic oligonucleotide"
gucgugccagaaggaaugaga

SEQ ID NO: 1406 - RNA, 21 nt, Artificial Sequence
  source: /note="Description of Artificial Sequence: Synthetic oligonucleotide"
caagaaagggaucuguguggc

SEQ ID NO: 1407 - RNA, 21 nt, Artificial Sequence
  source: /note="Description of Artificial Sequence: Synthetic oligonucleotide"
cugugcaagacuuccuaaaga

SEQ ID NO: 1408 - RNA, 21 nt, Artificial Sequence
  source: /note="Description of Artificial Sequence: Synthetic oligonucleotide"
ccagauccacuucaccaagaa

SEQ ID NO: 1409 - RNA, 21 nt, Artificial Sequence
  source: /note="Description of Artificial Sequence: Synthetic oligonucleotide"
gcugcugaaagacuuugacuc

SEQ ID NO: 1410 - RNA, 23 nt, Artificial Sequence
  source: /note="Description of Artificial Sequence: Synthetic oligonucleotide"
uaugaagcaauucuccucagcac

SEQ ID NO: 1411 - RNA, 23 nt, Artificial Sequence
  source: /note="Description of Artificial Sequence: Synthetic oligonucleotide"
uuuuguaugaagcaauucuccuc

SEQ ID NO: 1412 - RNA, 23 nt, Artificial Sequence
  source: /note="Description of Artificial Sequence: Synthetic oligonucleotide"
aagucaaagucuuuuagcugcag

SEQ ID NO: 1413 - RNA, 23 nt, Artificial Sequence
  source: /note="Description of Artificial Sequence: Synthetic oligonucleotide"
aauggucuugucugucuggauga

SEQ ID NO: 1414 - RNA, 23 nt, Artificial Sequence
  source: /note="Description of Artificial Sequence: Synthetic oligonucleotide"
uuguagauggucuugucugucug

SEQ ID NO: 1415 - RNA, 23 nt, Artificial Sequence
  source: /note="Description of Artificial Sequence: Synthetic oligonucleotide"
agagagaagaccuugaccacgua

SEQ ID NO: 1416 - RNA, 23 nt, Artificial Sequence
  source: /note="Description of Artificial Sequence: Synthetic oligonucleotide"
agauggucuugucugucuggaug

SEQ ID NO: 1417 - RNA, 23 nt, Artificial Sequence
  source: /note="Description of Artificial Sequence: Synthetic oligonucleotide"
aacagccacaguuuuguucauuc

SEQ ID NO: 1418 - RNA, 23 nt, Artificial Sequence
  source: /note="Description of Artificial Sequence: Synthetic oligonucleotide"
aaggcuuggaauaccaugaaggu

SEQ ID NO: 1419 - RNA, 23 nt, Artificial Sequence
  source: /note="Description of Artificial Sequence: Synthetic oligonucleotide"
auggucuugucugucuggaugaa

SEQ ID NO: 1420 - RNA, 23 nt, Artificial Sequence
  source: /note="Description of Artificial Sequence: Synthetic oligonucleotide"
uagauggucuugucugucuggau

SEQ ID NO: 1421 - RNA, 23 nt, Artificial Sequence
  source: /note="Description of Artificial Sequence: Synthetic oligonucleotide"
guguagauggucuugucugucug

SEQ ID NO: 1422 - RNA, 23 nt, Artificial Sequence
  source: /note="Description of Artificial Sequence: Synthetic oligonucleotide"
agagaagaccuugaccacguagg

SEQ ID NO: 1423 - RNA, 23 nt, Artificial Sequence
  source: /note="Description of Artificial Sequence: Synthetic oligonucleotide"
uguagauggucuugucugucugg

SEQ ID NO: 1424 - RNA, 23 nt, Artificial Sequence
  source: /note="Description of Artificial Sequence: Synthetic oligonucleotide"
gagagaagaccuugaccacguag

SEQ ID NO: 1425 - RNA, 23 nt, Artificial Sequence
  source: /note="Description of Artificial Sequence: Synthetic oligonucleotide"
ucguagagauuccauuuuucucu

SEQ ID NO: 1426 - RNA, 23 nt, Artificial Sequence
  source: /note="Description of Artificial Sequence: Synthetic oligonucleotide"
aacgaacaccaugaggucaaagg

SEQ ID NO: 1427 - RNA, 23 nt, Artificial Sequence
  source: /note="Description of Artificial Sequence: Synthetic oligonucleotide"
agggguguagauggucuugucug

SEQ ID NO: 1428 - RNA, 23 nt, Artificial Sequence
  source: /note="Description of Artificial Sequence: Synthetic oligonucleotide"
ucugccacacagaucccuuucuu

SEQ ID NO: 1429 - RNA, 23 nt, Artificial Sequence
  source: /note="Description of Artificial Sequence: Synthetic oligonucleotide"
gucuuggugaaguggaucuggua

SEQ ID NO: 1430 - RNA, 23 nt, Artificial Sequence
  source: /note="Description of Artificial Sequence: Synthetic oligonucleotide"
cuugaggucgaauuuauuacagg

SEQ ID NO: 1431 - RNA, 23 nt, Artificial Sequence
  source: /note="Description of Artificial Sequence: Synthetic oligonucleotide"
gauggucuugucugucuggauga

SEQ ID NO: 1432 - RNA, 23 nt, Artificial Sequence
  source: /note="Description of Artificial Sequence: Synthetic oligonucleotide"
ugugaguuuguucuucuuguuca

SEQ ID NO: 1433 - RNA, 23 nt, Artificial Sequence
  source: /note="Description of Artificial Sequence: Synthetic oligonucleotide"
aauuugggugucuuggugaagug

SEQ ID NO: 1434 - RNA, 23 nt, Artificial Sequence
  source: /note="Description of Artificial Sequence: Synthetic oligonucleotide"
aucacgaacaccaugaggucaaa

SEQ ID NO: 1435 - RNA, 23 nt, Artificial Sequence
  source: /note="Description of Artificial Sequence: Synthetic oligonucleotide"
auuacugugaccucgaagggguc

SEQ ID NO: 1436 - RNA, 23 nt, Artificial Sequence
  source: /note="Description of Artificial Sequence: Synthetic oligonucleotide"
uguguagauggucuugucugucu

SEQ ID NO: 1437 - RNA, 23 nt, Artificial Sequence
  source: /note="Description of Artificial Sequence: Synthetic oligonucleotide"
accaaucauuucuuggugaauca

SEQ ID NO: 1438 - RNA, 23 nt, Artificial Sequence
  source: /note="Description of Artificial Sequence: Synthetic oligonucleotide"
aucauaguguucuuggcauccug

SEQ ID NO: 1439 - RNA, 23 nt, Artificial Sequence
  source: /note="Description of Artificial Sequence: Synthetic oligonucleotide"
ucucuguagguucauguaguugg

SEQ ID NO: 1440 - RNA, 23 nt, Artificial Sequence
  source: /note="Description of Artificial Sequence: Synthetic oligonucleotide"
gucacgaacaccaugaggucaaa

SEQ ID NO: 1441 - RNA, 23 nt, Artificial Sequence
  source: /note="Description of Artificial Sequence: Synthetic oligonucleotide"
aaguuugccaccacugucacgua

SEQ ID NO: 1442 - RNA, 23 nt, Artificial Sequence
  source: /note="Description of Artificial Sequence: Synthetic oligonucleotide"
uccacuaugaccucgaaacuggg

SEQ ID NO: 1443 - RNA, 23 nt, Artificial Sequence
  source: /note="Description of Artificial Sequence: Synthetic oligonucleotide"
uggucugccacacagaucccuuu

SEQ ID NO: 1444 - RNA, 23 nt, Artificial Sequence
  source: /note="Description of Artificial Sequence: Synthetic oligonucleotide"
gggucugccacacagaucccuuu

SEQ ID NO: 1445 - RNA, 23 nt, Artificial Sequence
  source: /note="Description of Artificial Sequence: Synthetic oligonucleotide"
uagagaagaccuugaccacguag

SEQ ID NO: 1446 - RNA, 23 nt, Artificial Sequence
  source: /note="Description of Artificial Sequence: Synthetic oligonucleotide"
aauguuccaagacaaaggcaaga

SEQ ID NO: 1447 - RNA, 23 nt, Artificial Sequence
  source: /note="Description of Artificial Sequence: Synthetic oligonucleotide"
gguucuuucaacucuucuauggu

SEQ ID NO: 1448 - RNA, 23 nt, Artificial Sequence
  source: /note="Description of Artificial Sequence: Synthetic oligonucleotide"
auucugauuccuuccggcacgac

SEQ ID NO: 1449 - RNA, 23 nt, Artificial Sequence
  source: /note="Description of Artificial Sequence: Synthetic oligonucleotide"
uugacguccacccacacggaguc

SEQ ID NO: 1450 - RNA, 23 nt, Artificial Sequence
  source: /note="Description of Artificial Sequence: Synthetic oligonucleotide"
ucacgaacaccaugaggucaaag

SEQ ID NO: 1451 - RNA, 23 nt, Artificial Sequence
  source: /note="Description of Artificial Sequence: Synthetic oligonucleotide"
agagucaaagucuuucagcagca

SEQ ID NO: 1452 - RNA, 23 nt, Artificial Sequence
  source: /note="Description of Artificial Sequence: Synthetic oligonucleotide"
uccacacagaucccuuucuuguc

SEQ ID NO: 1453 - RNA, 23 nt, Artificial Sequence
  source: /note="Description of Artificial Sequence: Synthetic oligonucleotide"
ugccacacagaucccuuucuugu

SEQ ID NO: 1454 - RNA, 23 nt, Artificial Sequence
  source: /note="Description of Artificial Sequence: Synthetic oligonucleotide"
cacgaacaccaugaggucaaagg

SEQ ID NO: 1455 - RNA, 23 nt, Artificial Sequence
  source: /note="Description of Artificial Sequence: Synthetic oligonucleotide"
uuuaggaagucuugcacagugac

SEQ ID NO: 1456 - RNA, 23 nt, Artificial Sequence
  source: /note="Description of Artificial Sequence: Synthetic oligonucleotide"
ucuucuaugguccacaaccagcu

SEQ ID NO: 1457 - RNA, 23 nt, Artificial Sequence
  source: /note="Description of Artificial Sequence: Synthetic oligonucleotide"
uccaggaucagccauuuaacagc

SEQ ID NO: 1458 - RNA, 23 nt, Artificial Sequence
  source: /note="Description of Artificial Sequence: Synthetic oligonucleotide"
aggggucugccacacagaucccu

SEQ ID NO: 1459 - RNA, 23 nt, Artificial Sequence
  source: /note="Description of Artificial Sequence: Synthetic oligonucleotide"
gguguagauggucuugucugucu

SEQ ID NO: 1460 - RNA, 23 nt, Artificial Sequence
  source: /note="Description of Artificial Sequence: Synthetic oligonucleotide"
uuugccaccacugucacguacuu

SEQ ID NO: 1461 - RNA, 23 nt, Artificial Sequence
  source: /note="Description of Artificial Sequence: Synthetic oligonucleotide"
uugagaaagauguucaugaccuu

SEQ ID NO: 1462 - RNA, 23 nt, Artificial Sequence
  source: /note="Description of Artificial Sequence: Synthetic oligonucleotide"
ucucauuccuucuggcacgaccu

SEQ ID NO: 1463 - RNA, 23 nt, Artificial Sequence
  source: /note="Description of Artificial Sequence: Synthetic oligonucleotide"
gccacacagaucccuuucuuguc

SEQ ID NO: 1464 - RNA, 23 nt, Artificial Sequence
  source: /note="Description of Artificial Sequence: Synthetic oligonucleotide"
ucuuuaggaagucuugcacagug

SEQ ID NO: 1465 - RNA, 23 nt, Artificial Sequence
  source: /note="Description of Artificial Sequence: Synthetic oligonucleotide"
uucuuggugaaguggaucuggua

SEQ ID NO: 1466 - RNA, 23 nt, Artificial Sequence
  source: /note="Description of Artificial Sequence: Synthetic oligonucleotide"
gagucaaagucuuucagcagcag

SEQ ID NO: 1467 - RNA, 21 nt, Artificial Sequence
  source: /note="Description of Artificial Sequence: Synthetic oligonucleotide"
gcugaggagaauugcuucaua

SEQ ID NO: 1468 - RNA, 21 nt, Artificial Sequence
  source: /note="Description of Artificial Sequence: Synthetic oligonucleotide"
ggagaauugcuucauacaaaa

SEQ ID NO: 1469 - RNA, 21 nt, Artificial Sequence
  source: /note="Description of Artificial Sequence: Synthetic oligonucleotide"
gcagcuaaaagacuuugacuu

SEQ ID NO: 1470 - RNA, 21 nt, Artificial Sequence
  source: /note="Description of Artificial Sequence: Synthetic oligonucleotide"
auccagacagacaagaccauu

SEQ ID NO: 1471 - RNA, 21 nt, Artificial Sequence
  source: /note="Description of Artificial Sequence: Synthetic oligonucleotide"
gacagacaagaccaucuacaa

SEQ ID NO: 1472 - RNA, 21 nt, Artificial Sequence
  source: /note="Description of Artificial Sequence: Synthetic oligonucleotide"
cguggucaaggucuucucucu

SEQ ID NO: 1473 - RNA, 21 nt, Artificial Sequence
  source: /note="Description of Artificial Sequence: Synthetic oligonucleotide"
uccagacagacaagaccaucu

SEQ ID NO: 1474 - RNA, 21 nt, Artificial Sequence
  source: /note="Description of Artificial Sequence: Synthetic oligonucleotide"
augaacaaaacuguggcuguu

SEQ ID NO: 1475 - RNA, 21 nt, Artificial Sequence
  source: /note="Description of Artificial Sequence: Synthetic oligonucleotide"
cuucaugguauuccaagccuu

SEQ ID NO: 1476 - RNA, 21 nt, Artificial Sequence
  source: /note="Description of Artificial Sequence: Synthetic oligonucleotide"
cauccagacagacaagaccau

SEQ ID NO: 1477 - RNA, 21 nt, Artificial Sequence
  source: /note="Description of Artificial Sequence: Synthetic oligonucleotide"
ccagacagacaagaccaucua

SEQ ID NO: 1478 - RNA, 21 nt, Artificial Sequence
  source: /note="Description of Artificial Sequence: Synthetic oligonucleotide"
gacagacaagaccaucuacac

SEQ ID NO: 1479 - RNA, 21 nt, Artificial Sequence
  source: /note="Description of Artificial Sequence: Synthetic oligonucleotide"
uacguggucaaggucuucucu

SEQ ID NO: 1480 - RNA, 21 nt, Artificial Sequence
  source: /note="Description of Artificial Sequence: Synthetic oligonucleotide"
agacagacaagaccaucuaca

SEQ ID NO: 1481 - RNA, 21 nt, Artificial Sequence
  source: /note="Description of Artificial Sequence: Synthetic oligonucleotide"
acguggucaaggucuucucuc

SEQ ID NO: 1482 - RNA, 21 nt, Artificial Sequence
  source: /note="Description of Artificial Sequence: Synthetic oligonucleotide"
agaaaaauggaaucucuacga

SEQ ID NO: 1483 - RNA, 21 nt, Artificial Sequence
  source: /note="Description of Artificial Sequence: Synthetic oligonucleotide"
uuugaccucaugguguucguu

SEQ ID NO: 1484 - RNA, 21 nt, Artificial Sequence
  source: /note="Description of Artificial Sequence: Synthetic oligonucleotide"
gacaagaccaucuacaccccu

SEQ ID NO: 1485 - RNA, 21 nt, Artificial Sequence
  source: /note="Description of Artificial Sequence: Synthetic oligonucleotide"
gaaagggaucuguguggcaga

SEQ ID NO: 1486 - RNA, 21 nt, Artificial Sequence
  source: /note="Description of Artificial Sequence: Synthetic oligonucleotide"
ccagauccacuucaccaagac

SEQ ID NO: 1487 - RNA, 21 nt, Artificial Sequence
  source: /note="Description of Artificial Sequence: Synthetic oligonucleotide"
uguaauaaauucgaccucaag

SEQ ID NO: 1488 - RNA, 21 nt, Artificial Sequence
  source: /note="Description of Artificial Sequence: Synthetic oligonucleotide"
auccagacagacaagaccauc

SEQ ID NO: 1489 - RNA, 21 nt, Artificial Sequence
  source: /note="Description of Artificial Sequence: Synthetic oligonucleotide"
aacaagaagaacaaacucaca

SEQ ID NO: 1490 - RNA, 21 nt, Artificial Sequence
  source: /note="Description of Artificial Sequence: Synthetic oligonucleotide"
cuucaccaagacacccaaauu

SEQ ID NO: 1491 - RNA, 21 nt, Artificial Sequence
  source: /note="Description of Artificial Sequence: Synthetic oligonucleotide"
ugaccucaugguguucgugau

SEQ ID NO: 1492 - RNA, 21 nt, Artificial Sequence
  source: /note="Description of Artificial Sequence: Synthetic oligonucleotide"
ccccuucgaggucacaguaau

SEQ ID NO: 1493 - RNA, 21 nt, Artificial Sequence
  source: /note="Description of Artificial Sequence: Synthetic oligonucleotide"
acagacaagaccaucuacaca

SEQ ID NO: 1494 - RNA, 21 nt, Artificial Sequence
  source: /note="Description of Artificial Sequence: Synthetic oligonucleotide"
auucaccaagaaaugauuggu

SEQ ID NO: 1495 - RNA, 21 nt, Artificial Sequence
  source: /note="Description of Artificial Sequence: Synthetic oligonucleotide"
ggaugccaagaacacuaugau

SEQ ID NO: 1496 - RNA, 21 nt, Artificial Sequence
  source: /note="Description of Artificial Sequence: Synthetic oligonucleotide"
aacuacaugaaccuacagaga

SEQ ID NO: 1497 - RNA, 21 nt, Artificial Sequence
  source: /note="Description of Artificial Sequence: Synthetic oligonucleotide"
ugaccucaugguguucgugac

SEQ ID NO: 1498 - RNA, 21 nt, Artificial Sequence
  source: /note="Description of Artificial Sequence: Synthetic oligonucleotide"
cgugacagugguggcaaacuu

SEQ ID NO: 1499 - RNA, 21 nt, Artificial Sequence
  source: /note="Description of Artificial Sequence: Synthetic oligonucleotide"
caguuucgaggucauagugga

SEQ ID NO: 1500 - RNA, 21 nt, Artificial Sequence
  source: /note="Description of Artificial Sequence: Synthetic oligonucleotide"
agggaucuguguggcagacca

SEQ ID NO: 1501 - RNA, 21 nt, Artificial Sequence
  source: /note="Description of Artificial Sequence: Synthetic oligonucleotide"
agggaucuguguggcagaccc

SEQ ID NO: 1502 - RNA, 21 nt, Artificial Sequence
  source: /note="Description of Artificial Sequence: Synthetic oligonucleotide"
acguggucaaggucuucucua

SEQ ID NO: 1503 - RNA, 21 nt, Artificial Sequence
  source: /note="Description of Artificial Sequence: Synthetic oligonucleotide"
uugccuuugucuuggaacauu

SEQ ID NO: 1504 - RNA, 21 nt, Artificial Sequence
  source: /note="Description of Artificial Sequence: Synthetic oligonucleotide"
cauagaagaguugaaagaacc

SEQ ID NO: 1505 - RNA, 21 nt, Artificial Sequence
  source: /note="Description of Artificial Sequence: Synthetic oligonucleotide"
cgugccggaaggaaucagaau

SEQ ID NO: 1506 - RNA, 21 nt, Artificial Sequence
  source: /note="Description of Artificial Sequence: Synthetic oligonucleotide"
cuccguguggguggacgucaa

SEQ ID NO: 1507 - RNA, 21 nt, Artificial Sequence
  source: /note="Description of Artificial Sequence: Synthetic oligonucleotide"
uugaccucaugguguucguga

SEQ ID NO: 1508 - RNA, 21 nt, Artificial Sequence
  source: /note="Description of Artificial Sequence: Synthetic oligonucleotide"
cugcugaaagacuuugacucu

SEQ ID NO: 1509 - RNA, 21 nt, Artificial Sequence
  source: /note="Description of Artificial Sequence: Synthetic oligonucleotide"
caagaaagggaucugugugga

SEQ ID NO: 1510 - RNA, 21 nt, Artificial Sequence
  source: /note="Description of Artificial Sequence: Synthetic oligonucleotide"
aagaaagggaucuguguggca

SEQ ID NO: 1511 - RNA, 21 nt, Artificial Sequence
  source: /note="Description of Artificial Sequence: Synthetic oligonucleotide"
uuugaccucaugguguucgug

SEQ ID NO: 1512 - RNA, 21 nt, Artificial Sequence
  source: /note="Description of Artificial Sequence: Synthetic oligonucleotide"
cacugugcaagacuuccuaaa

SEQ ID NO: 1513 - RNA, 21 nt, Artificial Sequence
  source: /note="Description of Artificial Sequence: Synthetic oligonucleotide"
cugguuguggaccauagaaga

SEQ ID NO: 1514 - RNA, 21 nt, Artificial Sequence
  source: /note="Description of Artificial Sequence: Synthetic oligonucleotide"
uguuaaauggcugauccugga

SEQ ID NO: 1515 - RNA, 21 nt, Artificial Sequence
  source: /note="Description of Artificial Sequence: Synthetic oligonucleotide"
ggaucuguguggcagaccccu

SEQ ID NO: 1516 - RNA, 21 nt, Artificial Sequence
  source: /note="Description of Artificial Sequence: Synthetic oligonucleotide"
acagacaagaccaucuacacc

SEQ ID NO: 1517 - RNA, 21 nt, Artificial Sequence
  source: /note="Description of Artificial Sequence: Synthetic oligonucleotide"
guacgugacagugguggcaaa

SEQ ID NO: 1518 - RNA, 21 nt, Artificial Sequence
  source: /note="Description of Artificial Sequence: Synthetic oligonucleotide"
ggucaugaacaucuuucucaa

SEQ ID NO: 1519 - RNA, 21 nt, Artificial Sequence
  source: /note="Description of Artificial Sequence: Synthetic oligonucleotide"
gucgugccagaaggaaugaga

SEQ ID NO: 1520 - RNA, 21 nt, Artificial Sequence
  source: /note="Description of Artificial Sequence: Synthetic oligonucleotide"
caagaaagggaucuguguggc

SEQ ID NO: 1521 - RNA, 21 nt, Artificial Sequence
  source: /note="Description of Artificial Sequence: Synthetic oligonucleotide"
cugugcaagacuuccuaaaga

SEQ ID NO: 1522 - RNA, 21 nt, Artificial Sequence
  source: /note="Description of Artificial Sequence: Synthetic oligonucleotide"
ccagauccacuucaccaagaa

SEQ ID NO: 1523 - RNA, 21 nt, Artificial Sequence
  source: /note="Description of Artificial Sequence: Synthetic oligonucleotide"
gcugcugaaagacuuugacuc

SEQ ID NO: 1524 - RNA, 23 nt, Artificial Sequence
  source: /note="Description of Artificial Sequence: Synthetic oligonucleotide"
uaugaagcaauucuccucagcac

SEQ ID NO: 1525 - RNA, 23 nt, Artificial Sequence
  source: /note="Description of Artificial Sequence: Synthetic oligonucleotide"
uuuuguaugaagcaauucuccuc

SEQ ID NO: 1526 - RNA, 23 nt, Artificial Sequence
  source: /note="Description of Artificial Sequence: Synthetic oligonucleotide"
aagucaaagucuuuuagcugcag

SEQ ID NO: 1527 - RNA, 23 nt, Artificial Sequence
  source: /note="Description of Artificial Sequence: Synthetic oligonucleotide"
aauggucuugucugucuggauga

SEQ ID NO: 1528 - RNA, 23 nt, Artificial Sequence
  source: /note="Description of Artificial Sequence: Synthetic oligonucleotide"
uuguagauggucuugucugucug

SEQ ID NO: 1529 - RNA, 23 nt, Artificial Sequence
  source: /note="Description of Artificial Sequence: Synthetic oligonucleotide"
agagagaagaccuugaccacgua

SEQ ID NO: 1530 - RNA, 23 nt, Artificial Sequence
  source: /note="Description of Artificial Sequence: Synthetic oligonucleotide"
agauggucuugucugucuggaug

SEQ ID NO: 1531 - RNA, 23 nt, Artificial Sequence
  source: /note="Description of Artificial Sequence: Synthetic oligonucleotide"
aacagccacaguuuuguucauuc

SEQ ID NO: 1532 - RNA, 23 nt, Artificial Sequence
  source: /note="Description of Artificial Sequence: Synthetic oligonucleotide"
aaggcuuggaauaccaugaaggu

SEQ ID NO: 1533 - RNA, 23 nt, Artificial Sequence
  source: /note="Description of Artificial Sequence: Synthetic oligonucleotide"
auggucuugucugucuggaugaa

SEQ ID NO: 1534 - RNA, 23 nt, Artificial Sequence
  source: /note="Description of Artificial Sequence: Synthetic oligonucleotide"
uagauggucuugucugucuggau

SEQ ID NO: 1535 - RNA, 23 nt, Artificial Sequence
  source: /note="Description of Artificial Sequence: Synthetic oligonucleotide"
guguagauggucuugucugucug

SEQ ID NO: 1536 - RNA, 23 nt, Artificial Sequence
  source: /note="Description of Artificial Sequence: Synthetic oligonucleotide"
agagaagaccuugaccacguagg

SEQ ID NO: 1537 - RNA, 23 nt, Artificial Sequence
  source: /note="Description of Artificial Sequence: Synthetic oligonucleotide"
uguagauggucuugucugucugg

SEQ ID NO: 1538 - RNA, 23 nt, Artificial Sequence
  source: /note="Description of Artificial Sequence: Synthetic oligonucleotide"
gagagaagaccuugaccacguag

SEQ ID NO: 1539 - RNA, 23 nt, Artificial Sequence
  source: /note="Description of Artificial Sequence: Synthetic oligonucleotide"
ucguagagauuccauuuuucucu

SEQ ID NO: 1540 - RNA, 23 nt, Artificial Sequence
  source: /note="Description of Artificial Sequence: Synthetic oligonucleotide"
aacgaacaccaugaggucaaagg

SEQ ID NO: 1541 - RNA, 23 nt, Artificial Sequence
  source: /note="Description of Artificial Sequence: Synthetic oligonucleotide"
agggguguagauggucuugucug

SEQ ID NO: 1542 - RNA, 23 nt, Artificial Sequence
  source: /note="Description of Artificial Sequence: Synthetic oligonucleotide"
ucugccacacagaucccuuucuu

SEQ ID NO: 1543 - RNA, 23 nt, Artificial Sequence
  source: /note="Description of Artificial Sequence: Synthetic oligonucleotide"
gucuuggugaaguggaucuggua

SEQ ID NO: 1544 - RNA, 23 nt, Artificial Sequence
  source: /note="Description of Artificial Sequence: Synthetic oligonucleotide"
cuugaggucgaauuuauuacagg

SEQ ID NO: 1545 - RNA, 23 nt, Artificial Sequence
  source: /note="Description of Artificial Sequence: Synthetic oligonucleotide"
gauggucuugucugucuggauga

SEQ ID NO: 1546 - RNA, 23 nt, Artificial Sequence
  source: /note="Description of Artificial Sequence: Synthetic oligonucleotide"
ugugaguuuguucuucuuguuca

SEQ ID NO: 1547 - RNA, 23 nt, Artificial Sequence
  source: /note="Description of Artificial Sequence: Synthetic oligonucleotide"
aauuugggugucuuggugaagug

SEQ ID NO: 1548 - RNA, 23 nt, Artificial Sequence
  source: /note="Description of Artificial Sequence: Synthetic oligonucleotide"
aucacgaacaccaugaggucaaa

SEQ ID NO: 1549 - RNA, 23 nt, Artificial Sequence
  source: /note="Description of Artificial Sequence: Synthetic oligonucleotide"
auuacugugaccucgaagggguc

SEQ ID NO: 1550 - RNA, 23 nt, Artificial Sequence
  source: /note="Description of Artificial Sequence: Synthetic oligonucleotide"
uguguagauggucuugucugucu

SEQ ID NO: 1551 - RNA, 23 nt, Artificial Sequence
  source: /note="Description of Artificial Sequence: Synthetic oligonucleotide"
accaaucauuucuuggugaauca

SEQ ID NO: 1552 - RNA, 23 nt, Artificial Sequence
  source: /note="Description of Artificial Sequence: Synthetic oligonucleotide"
aucauaguguucuuggcauccug

SEQ ID NO: 1553 - RNA, 23 nt, Artificial Sequence
  source: /note="Description of Artificial Sequence: Synthetic oligonucleotide"
ucucuguagguucauguaguugg

SEQ ID NO: 1554 - RNA, 23 nt, Artificial Sequence
  source: /note="Description of Artificial Sequence: Synthetic oligonucleotide"
gucacgaacaccaugaggucaaa

SEQ ID NO: 1555 - RNA, 23 nt, Artificial Sequence
  source: /note="Description of Artificial Sequence: Synthetic oligonucleotide"
aaguuugccaccacugucacgua

SEQ ID NO: 1556 - RNA, 23 nt, Artificial Sequence
  source: /note="Description of Artificial Sequence: Synthetic oligonucleotide"
uccacuaugaccucgaaacuggg

SEQ ID NO: 1557 - RNA, 23 nt, Artificial Sequence
  source: /note="Description of Artificial Sequence: Synthetic oligonucleotide"
uggucugccacacagaucccuuu

SEQ ID NO: 1558 - RNA, 23 nt, Artificial Sequence
  source: /note="Description of Artificial Sequence: Synthetic oligonucleotide"
gggucugccacacagaucccuuu

SEQ ID NO: 1559 - RNA, 23 nt, Artificial Sequence
  source: /note="Description of Artificial Sequence: Synthetic oligonucleotide"
uagagaagaccuugaccacguag

SEQ ID NO: 1560 - RNA, 23 nt, Artificial Sequence
  source: /note="Description of Artificial Sequence: Synthetic oligonucleotide"
aauguuccaagacaaaggcaaga

SEQ ID NO: 1561 - RNA, 23 nt, Artificial Sequence
  source: /note="Description of Artificial Sequence: Synthetic oligonucleotide"
gguucuuucaacucuucuauggu

SEQ ID NO: 1562 - RNA, 23 nt, Artificial Sequence
  source: /note="Description of Artificial Sequence: Synthetic oligonucleotide"
auucugauuccuuccggcacgac

SEQ ID NO: 1563 - RNA, 23 nt, Artificial Sequence
  source: /note="Description of Artificial Sequence: Synthetic oligonucleotide"
uugacguccacccacacggaguc

SEQ ID NO: 1564 - RNA, 23 nt, Artificial Sequence
  source: /note="Description of Artificial Sequence: Synthetic oligonucleotide"
ucacgaacaccaugaggucaaag

SEQ ID NO: 1565 - RNA, 23 nt, Artificial Sequence
  source: /note="Description of Artificial Sequence: Synthetic oligonucleotide"
agagucaaagucuuucagcagca

SEQ ID NO: 1566 - RNA, 23 nt, Artificial Sequence
  source: /note="Description of Artificial Sequence: Synthetic oligonucleotide"
uccacacagaucccuuucuuguc

SEQ ID NO: 1567 - RNA, 23 nt, Artificial Sequence
  source: /note="Description of Artificial Sequence: Synthetic oligonucleotide"
ugccacacagaucccuuucuugu

SEQ ID NO: 1568 - RNA, 23 nt, Artificial Sequence
  source: /note="Description of Artificial Sequence: Synthetic oligonucleotide"
cacgaacaccaugaggucaaagg

SEQ ID NO: 1569 - RNA, 23 nt, Artificial Sequence
  source: /note="Description of Artificial Sequence: Synthetic oligonucleotide"
uuuaggaagucuugcacagugac

SEQ ID NO: 1570 - RNA, 23 nt, Artificial Sequence
  source: /note="Description of Artificial Sequence: Synthetic oligonucleotide"
ucuucuaugguccacaaccagcu

SEQ ID NO: 1571 - RNA, 23 nt, Artificial Sequence
  source: /note="Description of Artificial Sequence: Synthetic oligonucleotide"
uccaggaucagccauuuaacagc

SEQ ID NO: 1572 - RNA, 23 nt, Artificial Sequence
  source: /note="Description of Artificial Sequence: Synthetic oligonucleotide"
aggggucugccacacagaucccu

SEQ ID NO: 1573 - RNA, 23 nt, Artificial Sequence
  source: /note="Description of Artificial Sequence: Synthetic oligonucleotide"
gguguagauggucuugucugucu

SEQ ID NO: 1574 - RNA, 23 nt, Artificial Sequence
  source: /note="Description of Artificial Sequence: Synthetic oligonucleotide"
uuugccaccacugucacguacuu

SEQ ID NO: 1575 - RNA, 23 nt, Artificial Sequence
  source: /note="Description of Artificial Sequence: Synthetic oligonucleotide"
uugagaaagauguucaugaccuu

SEQ ID NO: 1576 - RNA, 23 nt, Artificial Sequence
  source: /note="Description of Artificial Sequence: Synthetic oligonucleotide"
ucucauuccuucuggcacgaccu

SEQ ID NO: 1577 - RNA, 23 nt, Artificial Sequence
  source: /note="Description of Artificial Sequence: Synthetic oligonucleotide"
gccacacagaucccuuucuuguc

SEQ ID NO: 1578 - RNA, 23 nt, Artificial Sequence
  source: /note="Description of Artificial Sequence: Synthetic oligonucleotide"
ucuuuaggaagucuugcacagug

SEQ ID NO: 1579 - RNA, 23 nt, Artificial Sequence
  source: /note="Description of Artificial Sequence: Synthetic oligonucleotide"
uucuuggugaaguggaucuggua

SEQ ID NO: 1580 - RNA, 23 nt, Artificial Sequence
  source: /note="Description of Artificial Sequence: Synthetic oligonucleotide"
gagucaaagucuuucagcagcag

SEQ ID NO: 1581 - RNA, 23 nt, Artificial Sequence
  source: /note="Description of Artificial Sequence: Synthetic oligonucleotide"
gugcugaggagaauugcuucaua

SEQ ID NO: 1582 - RNA, 23 nt, Artificial Sequence
  source: /note="Description of Artificial Sequence: Synthetic oligonucleotide"
gaggagaauugcuucauacaaaa

SEQ ID NO: 1583 - RNA, 23 nt, Artificial Sequence
  source: /note="Description of Artificial Sequence: Synthetic oligonucleotide"
cugcagcuaaaagacuuugacuu

SEQ ID NO: 1584 - RNA, 23 nt, Artificial Sequence
  source: /note="Description of Artificial Sequence: Synthetic oligonucleotide"
ucauccagacagacaagaccauc

SEQ ID NO: 1585 - RNA, 23 nt, Artificial Sequence
  source: /note="Description of Artificial Sequence: Synthetic oligonucleotide"
cagacagacaagaccaucuacac

SEQ ID NO: 1586 - RNA, 23 nt, Artificial Sequence
  source: /note="Description of Artificial Sequence: Synthetic oligonucleotide"
uacguggucaaggucuucucucu

SEQ ID NO: 1587 - RNA, 23 nt, Artificial Sequence
  source: /note="Description of Artificial Sequence: Synthetic oligonucleotide"
cauccagacagacaagaccaucu

SEQ ID NO: 1588 - RNA, 23 nt, Artificial Sequence
  source: /note="Description of Artificial Sequence: Synthetic oligonucleotide"
gaaugaacaaaacuguggcuguu

SEQ ID NO: 1589 - RNA, 23 nt, Artificial Sequence
  source: /note="Description of Artificial Sequence: Synthetic oligonucleotide"
accuucaugguauuccaagccuu

SEQ ID NO: 1590 - RNA, 23 nt, Artificial Sequence
  source: /note="Description of Artificial Sequence: Synthetic oligonucleotide"
uucauccagacagacaagaccau

SEQ ID NO: 1591 - RNA, 23 nt, Artificial Sequence
  source: /note="Description of Artificial Sequence: Synthetic oligonucleotide"
auccagacagacaagaccaucua

SEQ ID NO: 1592 - RNA, 23 nt, Artificial Sequence
  source: /note="Description of Artificial Sequence: Synthetic oligonucleotide"
cagacagacaagaccaucuacac

SEQ ID NO: 1593 - RNA, 23 nt, Artificial Sequence
  source: /note="Description of Artificial Sequence: Synthetic oligonucleotide"
ccuacguggucaaggucuucucu

SEQ ID NO: 1594 - RNA, 23 nt, Artificial Sequence
  source: /note="Description of Artificial Sequence: Synthetic oligonucleotide"
ccagacagacaagaccaucuaca

SEQ ID NO: 1595 - RNA, 23 nt, Artificial Sequence
  source: /note="Description of Artificial Sequence: Synthetic oligonucleotide"
cuacguggucaaggucuucucuc

SEQ ID NO: 1596 - RNA, 23 nt, Artificial Sequence
  source: /note="Description of Artificial Sequence: Synthetic oligonucleotide"
agagaaaaauggaaucucuacga

SEQ ID NO: 1597 - RNA, 23 nt, Artificial Sequence
  source: /note="Description of Artificial Sequence: Synthetic oligonucleotide"
ccuuugaccucaugguguucgug

SEQ ID NO: 1598 - RNA, 23 nt, Artificial Sequence
  source: /note="Description of Artificial Sequence: Synthetic oligonucleotide"
cagacaagaccaucuacaccccu

SEQ ID NO: 1599 - RNA, 23 nt, Artificial Sequence
  source: /note="Description of Artificial Sequence: Synthetic oligonucleotide"
aagaaagggaucuguguggcaga

SEQ ID NO: 1600 - RNA, 23 nt, Artificial Sequence
  source: /note="Description of Artificial Sequence: Synthetic oligonucleotide"
uaccagauccacuucaccaagac

SEQ ID NO: 1601 - RNA, 23 nt, Artificial Sequence
  source: /note="Description of Artificial Sequence: Synthetic oligonucleotide"
ccuguaauaaauucgaccucaag

SEQ ID NO: 1602 - RNA, 23 nt, Artificial Sequence
  source: /note="Description of Artificial Sequence: Synthetic oligonucleotide"
ucauccagacagacaagaccauc

SEQ ID NO: 1603 - RNA, 23 nt, Artificial Sequence
  source: /note="Description of Artificial Sequence: Synthetic oligonucleotide"
ugaacaagaagaacaaacucaca

SEQ ID NO: 1604 - RNA, 23 nt, Artificial Sequence
  source: /note="Description of Artificial Sequence: Synthetic oligonucleotide"
cacuucaccaagacacccaaauu

SEQ ID NO: 1605 - RNA, 23 nt, Artificial Sequence
  source: /note="Description of Artificial Sequence: Synthetic oligonucleotide"
uuugaccucaugguguucgugac

SEQ ID NO: 1606 - RNA, 23 nt, Artificial Sequence
  source: /note="Description of Artificial Sequence: Synthetic oligonucleotide"
gaccccuucgaggucacaguaau

SEQ ID NO: 1607 - RNA, 23 nt, Artificial Sequence
  source: /note="Description of Artificial Sequence: Synthetic oligonucleotide"
agacagacaagaccaucuacacc

SEQ ID NO: 1608 - RNA, 23 nt, Artificial Sequence
  source: /note="Description of Artificial Sequence: Synthetic oligonucleotide"
ugauucaccaagaaaugauuggu

SEQ ID NO: 1609 - RNA, 23 nt, Artificial Sequence
  source: /note="Description of Artificial Sequence: Synthetic oligonucleotide"
caggaugccaagaacacuaugau

SEQ ID NO: 1610 - RNA, 23 nt, Artificial Sequence
  source: /note="Description of Artificial Sequence: Synthetic oligonucleotide"
ccaacuacaugaaccuacagaga

SEQ ID NO: 1611 - RNA, 23 nt, Artificial Sequence
  source: /note="Description of Artificial Sequence: Synthetic oligonucleotide"
uuugaccucaugguguucgugac

SEQ ID NO: 1612 - RNA, 23 nt, Artificial Sequence
  source: /note="Description of Artificial Sequence: Synthetic oligonucleotide"
uacgugacagugguggcaaacuu

SEQ ID NO: 1613 - RNA, 23 nt, Artificial Sequence
  source: /note="Description of Artificial Sequence: Synthetic oligonucleotide"
cccaguuucgaggucauagugga

SEQ ID NO: 1614 - RNA, 23 nt, Artificial Sequence
  source: /note="Description of Artificial Sequence: Synthetic oligonucleotide"
aaagggaucuguguggcagaccc

SEQ ID NO: 1615 - RNA, 23 nt, Artificial Sequence
  source: /note="Description of Artificial Sequence: Synthetic oligonucleotide"
aaagggaucuguguggcagaccc

SEQ ID NO: 1616 - RNA, 23 nt, Artificial Sequence
  source: /note="Description of Artificial Sequence: Synthetic oligonucleotide"
cuacguggucaaggucuucucuc

SEQ ID NO: 1617 - RNA, 23 nt, Artificial Sequence
  source: /note="Description of Artificial Sequence: Synthetic oligonucleotide"
ucuugccuuugucuuggaacauu

SEQ ID NO: 1618 - RNA, 23 nt, Artificial Sequence
  source: /note="Description of Artificial Sequence: Synthetic oligonucleotide"
accauagaagaguugaaagaacc

SEQ ID NO: 1619 - RNA, 23 nt, Artificial Sequence
  source: /note="Description of Artificial Sequence: Synthetic oligonucleotide"
gucgugccggaaggaaucagaau

SEQ ID NO: 1620 - RNA, 23 nt, Artificial Sequence
  source: /note="Description of Artificial Sequence: Synthetic oligonucleotide"
gacuccguguggguggacgucaa

SEQ ID NO: 1621 - RNA, 23 nt, Artificial Sequence
  source: /note="Description of Artificial Sequence: Synthetic oligonucleotide"
cuuugaccucaugguguucguga

SEQ ID NO: 1622 - RNA, 23 nt, Artificial Sequence
  source: /note="Description of Artificial Sequence: Synthetic oligonucleotide"
ugcugcugaaagacuuugacucu

SEQ ID NO: 1623 - RNA, 23 nt, Artificial Sequence
  source: /note="Description of Artificial Sequence: Synthetic oligonucleotide"
gacaagaaagggaucuguguggc

SEQ ID NO: 1624 - RNA, 23 nt, Artificial Sequence
  source: /note="Description of Artificial Sequence: Synthetic oligonucleotide"
acaagaaagggaucuguguggca

SEQ ID NO: 1625 - RNA, 23 nt, Artificial Sequence
  source: /note="Description of Artificial Sequence: Synthetic oligonucleotide"
ccuuugaccucaugguguucgug

SEQ ID NO: 1626 - RNA, 23 nt, Artificial Sequence
  source: /note="Description of Artificial Sequence: Synthetic oligonucleotide"
gucacugugcaagacuuccuaaa

SEQ ID NO: 1627 - RNA, 23 nt, Artificial Sequence
  source: /note="Description of Artificial Sequence: Synthetic oligonucleotide"
agcugguuguggaccauagaaga

SEQ ID NO: 1628 - RNA, 23 nt, Artificial Sequence
  source: /note="Description of Artificial Sequence: Synthetic oligonucleotide"
gcuguuaaauggcugauccugga

SEQ ID NO: 1629 - RNA, 23 nt, Artificial Sequence
  source: /note="Description of Artificial Sequence: Synthetic oligonucleotide"
agggaucuguguggcagaccccu

SEQ ID NO: 1630 - RNA, 23 nt, Artificial Sequence
  source: /note="Description of Artificial Sequence: Synthetic oligonucleotide"
agacagacaagaccaucuacacc

SEQ ID NO: 1631 - RNA, 23 nt, Artificial Sequence
  source: /note="Description of Artificial Sequence: Synthetic oligonucleotide"
aaguacgugacagugguggcaaa

SEQ ID NO: 1632 - RNA, 23 nt, Artificial Sequence
  source: /note="Description of Artificial Sequence: Synthetic oligonucleotide"
aaggucaugaacaucuuucucaa

SEQ ID NO: 1633 - RNA, 23 nt, Artificial Sequence
  source: /note="Description of Artificial Sequence: Synthetic oligonucleotide"
aggucgugccagaaggaaugaga

SEQ ID NO: 1634 - RNA, 23 nt, Artificial Sequence
  source: /note="Description of Artificial Sequence: Synthetic oligonucleotide"
gacaagaaagggaucuguguggc

SEQ ID NO: 1635 - RNA, 23 nt, Artificial Sequence
  source: /note="Description of Artificial Sequence: Synthetic oligonucleotide"
cacugugcaagacuuccuaaaga

SEQ ID NO: 1636 - RNA, 23 nt, Artificial Sequence
  source: /note="Description of Artificial Sequence: Synthetic oligonucleotide"
uaccagauccacuucaccaagac

SEQ ID NO: 1637 - RNA, 23 nt, Artificial Sequence
  source: /note="Description of Artificial Sequence: Synthetic oligonucleotide"
cugcugcugaaagacuuugacuc

SEQ ID NO: 1638 - RNA, 21 nt, Artificial Sequence
  source: /note="Description of Artificial Sequence: Synthetic oligonucleotide"
aacaagaagaacaaacucaca

SEQ ID NO: 1639 - RNA, 21 nt, Artificial Sequence
  source: /note="Description of Artificial Sequence: Synthetic oligonucleotide"
cgugacagugguggcaaacuu

SEQ ID NO: 1640 - RNA, 23 nt, Artificial Sequence
  source: /note="Description of Artificial Sequence: Synthetic oligonucleotide"
ugugaguuuguucuucuuguuca

SEQ ID NO: 1641 - RNA, 23 nt, Artificial Sequence
  source: /note="Description of Artificial Sequence: Synthetic oligonucleotide"
aaguuugccaccacugucacgua

We claim:

1. A double stranded ribonucleic acid (dsRNA) agent for inhibiting expression of complement component C3 in a cell, wherein said dsRNA comprises a sense strand and an antisense strand forming a double stranded region,
   wherein each strand is independently 15-30 nucleotides in length,
   wherein the antisense strand comprises at least 15 contiguous nucleotides from the complement of nucleotides 4614-4632 of SEQ ID NO:1,
   wherein all of the nucleotides of the sense strand and all of the nucleotides of the antisense strand comprise a nucleotide modification, and
   wherein at least one strand is conjugated to a ligand.

2. The dsRNA agent of claim 1, further comprising at least one phosphorothioate or methylphosphonate internucleotide linkage.

3. The dsRNA agent of claim 1, wherein at least one strand comprises a 3' overhang of at least one nucleotide.

4. The dsRNA agent of claim 1, wherein the ligand is conjugated to the 3' end of the sense strand of the dsRNA agent.

5. The dsRNA agent of claim 1, wherein the ligand is an N-acetylgalactosamine (GalNAc) derivative.

6. The dsRNA agent of claim 5, wherein the ligand is

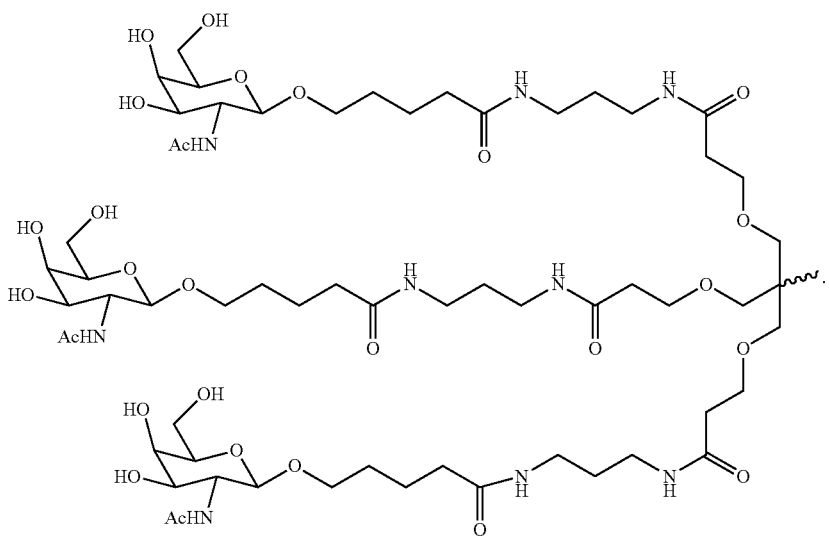 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

7. The dsRNA agent of claim 5, wherein the dsRNA agent is conjugated to the ligand as shown in the following schematic

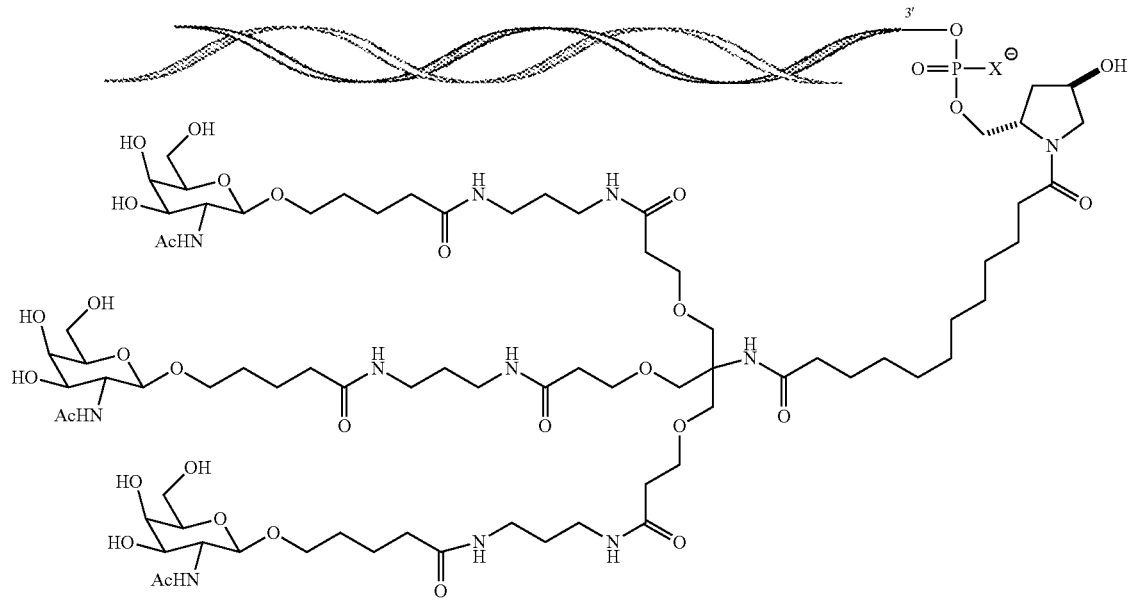

and, wherein X is O or S.

8. The dsRNA agent of claim 7, wherein the X is O.

9. An isolated cell comprising the dsRNA agent of claim 1.

10. A pharmaceutical composition for inhibiting expression of a complement component C3 gene comprising the dsRNA agent of claim 1.

11. The dsRNA agent of claim 1, wherein the antisense strand comprises at least 17 contiguous nucleotides from the complement of nucleotides 4614-4632 of SEQ ID NO:1.

12. The dsRNA agent of claim 1, wherein the antisense strand comprises at least 19 contiguous nucleotides from the complement of nucleotides 4614-4632 of SEQ ID NO:1.

13. The dsRNA agent of claim 1, wherein the sense strand comprises the nucleotide sequence 5'-UGAUGAACU-GUGCCGCUGU-3'(SEQ ID NO:248) and the antisense strand comprises the nucleotide sequence 5'-ACAGCGGCACAGUUCAUCA-3' (SEQ ID NO:516).

14. The dsRNA agent of claim 1, wherein each strand is independently 19-25 nucleotides in length.

15. The dsRNA agent of claim 1, wherein at least one of the nucleotide modifications is selected from the group consisting of a 2'-O-methyl nucleotide modification, a nucleotide comprising a 5'-phosphorothioate nucleotide group modification, a deoxy-nucleotide modification, a 3'-terminal deoxy-thymine (dT) nucleotide modification, a 2'-fluoro nucleotide modification, a 2'-deoxy-nucleotide modification, a terminal nucleotide linked to a cholesteryl derivative or a dodecanoic acid bisdecylamide group nucleotide modification, a 2'-deoxy-2'-fluoro nucleotide modification, a locked nucleotide modification, an unlocked nucleotide modification, a conformationally restricted nucleotide modification, a constrained ethyl nucleotide modification, an abasic nucleotide modification, a 2'-amino-nucleotide modification, a 2'-O-allyl-nucleotide modification, a 2'-C-alkyl-nucleotide modification, a 2'-hydroxyl-nucleotide modification, a 2'-methoxyethyl nucleotide modification, a 2'-O-alkyl-nucleotide modification, a morpholino nucleotide modification, a phosphoramidate modification, a non-natural base nucleotide modification, a tetrahydropyran nucleotide modification, a 1,5-anhydrohexitol nucleotide modification, a cyclohexenyl nucleotide modification, a 5'-phosphate nucleotide modification, and a 5'-phosphate mimic nucleotide modification.

16. The dsRNA agent of claim 2, wherein the phosphorothioate or methylphosphonate internucleotide linkage is at the 3'-terminus of one strand.

17. The dsRNA agent of claim 16, wherein the strand is the antisense strand.

18. The dsRNA agent of claim 16, wherein the strand is the sense strand.

19. The dsRNA agent of claim 2, wherein the phosphorothioate or methylphosphonate internucleotide linkage is at the 5'-terminus of one strand.

20. The dsRNA agent of claim 19, wherein the strand is the antisense strand.

21. The dsRNA agent of claim 19, wherein the strand is the sense strand.

22. The dsRNA agent of claim 2, wherein the phosphorothioate or methylphosphonate internucleotide linkage is at both the 5'- and 3'-terminus of one strand.

23. The dsRNA agent of claim 22, wherein the strand is the antisense strand.

24. A double stranded ribonucleic acid (dsRNA) agent for inhibiting expression of complement component C3 in a cell,
    wherein said dsRNA comprises a sense strand and an antisense strand forming a double stranded region,
    wherein each strand is independently 15-30 nucleotides in length,
    wherein the antisense strand comprises at least 15 contiguous nucleotides from the complement of nucleotides 4614-4632 of SEQ ID NO:1, wherein all of the nucleotide of the sense strand and all of the nucleotides of the antisense strand comprise a nucleotide modification, wherein the dsRNA agent comprises 6-8 phosphorothioate internucleotide linkages, and wherein at least one strand is conjugated to an N-acetylgalactosamine ligand.

* * * * *